US008293718B2

(12) United States Patent
Hinkle et al.

(10) Patent No.: US 8,293,718 B2
(45) Date of Patent: Oct. 23, 2012

(54) ORGANIC COMPOSITIONS TO TREAT HSF1-RELATED DISEASES

(75) Inventors: Gregory Hinkle, Cambridge, MA (US); Satyanarayana Kuchimanchi, Cambridge, MA (US); Stuart Milstein, Cambridge, MA (US); Markus Warmuth, Natick, MA (US); Wenlai Zhou, Newton, MA (US); Ping Zhu, Boxborough, MA (US); Tracy S. Zimmermann, Cambridge, MA (US)

(73) Assignee: Novartis AG, Basel (CH)

( * ) Notice: Subject to any disclaimer, the term of this patent is extended or adjusted under 35 U.S.C. 154(b) by 75 days.

(21) Appl. No.: 12/970,268

(22) Filed: Dec. 16, 2010

(65) Prior Publication Data

US 2011/0166058 A1 Jul. 7, 2011

Related U.S. Application Data

(60) Provisional application No. 61/288,137, filed on Dec. 18, 2009.

(51) Int. Cl.
*C12N 15/11* (2006.01)
(52) U.S. Cl. .................................. 514/44 A
(58) Field of Classification Search ............... 514/44 A
See application file for complete search history.

(56) References Cited

U.S. PATENT DOCUMENTS

| 6,506,559 | B1 * | 1/2003 | Fire et al. ............ 435/6.16 |
| 6,573,099 | B2 * | 6/2003 | Graham ............ 435/455 |
| 7,053,052 | B2 * | 5/2006 | Voellmy ............ 514/19.3 |
| 7,858,592 | B2 * | 12/2010 | Shames et al. ............ 514/44 R |
| 8,090,542 | B2 * | 1/2012 | Khvorova et al. ............ 702/20 |
| 8,168,606 | B2 | 5/2012 | Van Heeke et al. |
| 2007/0238682 | A1 | 10/2007 | Nudler et al. |
| 2009/0092600 | A1 | 4/2009 | Kufe |

FOREIGN PATENT DOCUMENTS

| WO | WO 03/000861 A2 | 1/2003 |
| WO | WO 2006/110688 A2 | 10/2006 |
| WO | WO 2007/002528 A1 | 1/2007 |
| WO | WO 2007/041294 A2 | 4/2007 |
| WO | WO 2008/022035 A2 | 2/2008 |
| WO | WO 2008/141074 A1 | 11/2008 |
| WO | WO 2009/103067 A2 | 8/2009 |

OTHER PUBLICATIONS

Parrish et al. (Molecular Cell 6. 1077-1087, 2000).*
Nagata 2003 Sem. in Cell Dev. Biol. 14:275-282.*
Glotzer 2000 Nature 407, 207-211.*
Li 2004 Antimicrob. Agents Chemother. 48, 867-872.*
Ohgitani 1999 J. Gen. Virol. 80:63-68.*
Kurashina 2009 Cancer Lett. 284, 62-70.*
Ito et al. 2010 Leukemia Res. 34:352-357.*
Agostini 2000 Exp. Cell Res. 259:398-403.*
Erkeller-Yuskei 1992 J. Autoimmunity 5:803-814.*
Laith et al. Trends in Pharmacological Sciences 28:526-535.*
Phillips et al. Journal of Virology 1991, 65:5682-5692.*
Benko et al. Retrovirology 2007, 4:16, pp. 1-14.*
Abravaya et al.; "The human heat shock protein hsp70 interacts with HSF, the transcription factor that regulates heat shock gene expression"; Genes Dev.; 6:1153-1164 (1992).
Cen et al.; "Induction of HSF1 expression is associated with sporadic colorectal cancer"; World J Gastroenterol; 10 (21):3122-3126 (2004).
Cervantes-Gomez et al.; "Transcription Inhibition of Heat Shock Proteins: A Strategy for Combination of 17-Allylamino-17-Demethoxygeldanamycin and Actinomycin D"; Cancer Res—Research Article; 69(9):3947-3954 (2009).
Chu et al.; "Sequential Phosphorylation by Mitogen-activated Protein Kinase and Glycogen Synthase Kinase 3 Represses Transcriptional Activation by Heat Shock Factor-1"; The Journal of Biological Chemistry; 271 (48):30847-30857 (1996).
Ciocca et al.; "Heat shock proteins in cancer: diagnostic, prognostic, predictive, and treatment implications"; Cell Stress & Chaperones; 10(2):86-103 (2005).
Dai et al.; "Heat Shock Factor 1 Is a Powerful Multifaceted Modifier of Carcinogenesis"; Cell; 130:1005-1018 (2007).
Dokladny et al.; "Cellular and Molecular Mechanisms of Heat Stress-Induced Up-Regulation of Occludin Protein Expression: Regulatory Role of Heat Shock Factor-1"; The American Journal of Pathology—Epithelial and Mesenchymal Cell Biology; 172(3):659-670 (2008).
Ferrarini et al.; "Unusual Expression and Localization of Heat-Shock Proteins in Human Tumor Cells"; Int. J. Cancer; 51:613-619 (1992).
Fuller et al.; "Cancer and the Heat Shock Response"; European Journal of Cancer—Feature Articles; 30A (12):1884-1891 (1994).
Green et al.; "A Heat Shock-Responsive Domain of Human HSF1 That Regulates Transcription Activation Domain Function"; Molecular and Cellular Biology; 15(6):3354-3362 (1995).
He et al.; "Elevated Expression of Heat Shock Factor (HSF) 2A Stimulates HSF1-induced Transcription during Stress"; The Journal of Biological Chemistry; 278(37):35465-35475 (2003).
Helmbrecht et al.; "Chaperones in cell cycle regulation and mitogenic signal transduction: a review"; Cell Prolif.—Review Article; 33:341-365 (2000).
Hoang et al.; "A Novel Association between the Human Heat Shock Transcription Factor 1 (HSF1) and Prostate Adenocarcinoma"; American Journal of Pathology; 156(3):857-864 (2000).
Homma et al.; "Demyelination, Astrogliosis, and Accumulation of Ubiquitinated Proteins, Hallmarks of CNS Disease in hsf1-Deficient Mice"; The Journal of Neuroscience; 27(30):7974—7986 (2007).
Hu et al.; "HSF-1 Interacts with Ral-binding Protein 1 in a Stress-responsive, Multiprotein Complex with HSP90 in Vivo"; The Journal of Biological Chemistry; 278(19):17299-17306 (2003).
Huang et al.; "Heat Shock Transcription Factor 1 Binds Selectively in Vitro to Ku Protein and the Catalytic Subunit of the DNA-dependent Protein Kinase"; The Journal of Biological Chemistry; 272(41):26009-26016 (1997).
Jacobs et al.; "Heat Shock Factor 1 Attenuates 4-Hydroxynonenal-mediated Apoptosis: Critical Role for Heat Shock Protein 70 Induction and Stabilization of Bcl-XL"; The Journal of Biological Chemistry; 282(46):33412-33420 (2007).
Jaattela; "Escaping Cell Death: Survival Proteins in Cancer"; Experimental Cell Research—Minireview; 248:30-43 (1999).
Jolly et al.; "Role of the Heat Shock Response and Molecular Chaperones in Oncogenesis and Cell Death"; Journal of the National Cancer Institute—Review; 92(19):1564-1572 (2000).

(Continued)

*Primary Examiner* — Brian Whiteman
(74) *Attorney, Agent, or Firm* — Frank Wu

(57) ABSTRACT

The present disclosure relates to methods of treating heat shock factor 1 (HSF1)-related diseases such as cancer and viral diseases, using a therapeutically effective amount of a RNAi agent to HSF.

51 Claims, 1 Drawing Sheet

OTHER PUBLICATIONS

Kim et al.; "Update on Hsp90 Inhibitors in Clinical Trial"; Current Topics in Medicinal Chemistry; 9:1479-1492 (2009).

Kline et al.; "Repression of the Heat Shock Factor 1 Transcriptional Activation Domain Is Modulated by Constitutive Phosphorylation"; Molecular and Cellular Biology; 17(4):2107-2115 (1997).

Macario et al.; "Mechanisms of Disease: Sick Chaperones, Cellular Stress, and Disease"; The New England Journal of Medicine—Review Article; 353(14):1489-1501 (2005).

Min et al.; "Selective suppression of lymphomas by functional loss of Hsf1 in a p53-deficient mouse model for spontaneous tumors"; Oncogene; 26:5086-5097 (2007).

Mosser et al.; "Molecular chaperones and the stress of oncogenesis"; Oncogene; 23:2907-2918 (2004).

Nair et al.; "A pathway of multi-chaperone interactions common to diverse regulatory proteins: estrogen receptor, Fes tyrosine kinase, heat shock transcription factor Hsf1, and the aryl hydrocarbon receptor"; Cell Stress & Chaperones; 1 (4):237-250 (1996).

Newton et al.; "The Regulatory Domain of Human Heat Shock Factor 1 is Sufficient to Sense Heat Stress"; Molecular and Cellular Biology; 16(3):839-846 (1996).

Nunes et al.; "Heat Shock Factor-1 and the Heat Shock Cognate 70 Protein Associate in High Molecular Weight Complexes in the Cytoplasm of NIH-3T3 Cells"; Biochemical and Biophysical Research Communications; 213(1):1-6 (1995).

Page et al.; "Genome-wide analysis of human HSF1 signaling reveals a transcriptional program linked to cellular adaptation and survival"; Mol. BioSyst.; 2:627-639 (2006).

Page et al.; "Genome-wide analysis of human HSF1 signaling reveals a transcriptional program linked to cellular adaptation and survival"; Mol. BioSyst.; 2:627-639 (2006)[Supplemental Material—Table I].

Powers et al.; "Inhibitors of the heat shock response: Biology and pharmacology"; FEBS Letters—. Minireview; 581:3758-3769 (2007).

Powers et al.; "Dual Targeting of HSC70 and HSP72 Inhibits HSP90 Function and Induces Tumor-Specific Apoptosis"; Cancer Cell; 14:250-262 (2008).

Rabindran et al.; "Molecular cloning and expression of a human heat shock factor, HSF1"; Proc. Nad. Acad. Sci. USA; 88:6906-6910 (1991).

Rossi et al.; "Targeting the Heat Shock Factor 1 by RNA Interference: A Potent Tool to Enhance Hyperthermochemotherapy Efficacy in Cervical Cancer"; Cancer Res; 66:7678-7685 (2006).

Satyal et al.; "Negative regulation of the heat shock transcriptional response by?HSBP1"; Genes Dev.; 12:1962-1974 (1998).

Schett et al.; "Enhanced Expression of Heat Shock Protein 70 (hsp70) and Heat Shock Factor 1 (HSF1) Activation in Rheumatoid Arthritis Synovial Tissue—Differential Regulation of hsp70 Expression and HSF1 Activation in Synovial Fibroblasts by Proinflammatory Cytokines, Shear Stress, and Antiinflammatory Drugs"; J. Clin. Invest.; 102(2):302-311 (1998).

Shamovsky et al.; "New insights into the mechanism of heat shock response activation"; Cell. Mol. Life Sci.—Visions & Reflections (Minireview); 65:855-861 (2008).

Shi et al.; "The Carboxyl-Terminal Transactivation Domain of Heat Shock Factor 1 is Negatively Regulated and Stress Responsive"; Molecular and Cellular Biology; 15(8):4309-4318 (1995).

Shi et al.; "Molecular chaperones as HSF1-specific transcriptional repressors"; Genes & Development; 12:654-666 (1998).

Sioud; "Induction of Inflammatory Cytokines and Interferon Responses by Double-stranded and Single-stranded siRNAs Sequence-dependent and Requires Endosomal Localization"; J. Mol. Biol.; 348:1079-1090 (2005).

Tang et al.; "Expression of heat shock proteins and heat shock protein messenger ribonucleic acid in human prostate carcinoma in vitro and in tumors in vivo"; Cell Stress & Chaperones; 10(1):46-58 (2005).

Wang et al.; "Expression of a Dominant Negative Heat Shock Factor-1 Construct Inhibits Aneuploidy in Prostate Carcinoma Cells"; The Journal of Biological Chemistry; 279(31):32651-32659 (2004).

Wei et al.; "Both Strands of siRNA Have Potential to Guide Post-transcriptional Gene Silencing in Mammalian Cells"; PLoS ONE; 4(4):e5382[1-10] (2009).

Whitesell et al.; "Inhibiting the transcription factor HSF1 as an anticancer strategy"; Expert Opin. Ther. Targets—Review; 13(4):469-478 (2009).

Xie et al.; "Heat Shock Factor 1 Represses Transcription of the IL-1beta Gene through Physical Interaction with the Nuclear Factor of Interleukin 6"; The Journal of Biological Chemistry; 277(14):11802-11810 (2002).

Xing et al.; "HSF1 Modulation of Hsp70 mRNA Polyadenylation via Interaction with Symplekin"; The Journal of Biological Chemistry; 279(11):10551-10555 (2004).

Yin et al.; "Silencing heat shock factor 1 by small interfering RNA abrogates heat shock-induced cardioprotection against ischemia—reperfusion injury in mice"; Journal of Molecular and Cellular Cardiology; 39:681-689 (2005).

Zanini et al.; "Inhibition of heat shock proteins (HSP) expression by quercetin and differential doxorubicin sensitization in neuroblastoma and Ewing's sarcoma cell lines"; Journal of Neurochemistry; 103:1344-1354 (2007).

Zhou et al.; "Heat Shock Transcription Factor-1 Regulates Heat Shock Protein-72 Expression in Human Keratinocytes Exposed to Ultraviolet B Light"; J. Invest Dermatol; 111(2):194-198 (1998).

Zuo et al.; "Activation of the DNA-Binding Ability of Human Heat Shock Transcription Factor 1 May Involve the Transition from an Intramolecular to an Intermolecular Triple-Stranded Coiled-Coil Structure"; Molecular and Cellular Biology; 14(11):7557-7568 (1994).

Zuo et al.; "Multiple Layers of Regulation of Human Heat Shock Transcription Factor 1"; Molecular and Cellular Biology; 15(8):4319-4330 (1995).

Elbashir et al., EMBO J., 20(33):6877-6888 (2001).

Saetrom, Bioinformatics, 20(17):3055-3063 (2004).

* cited by examiner

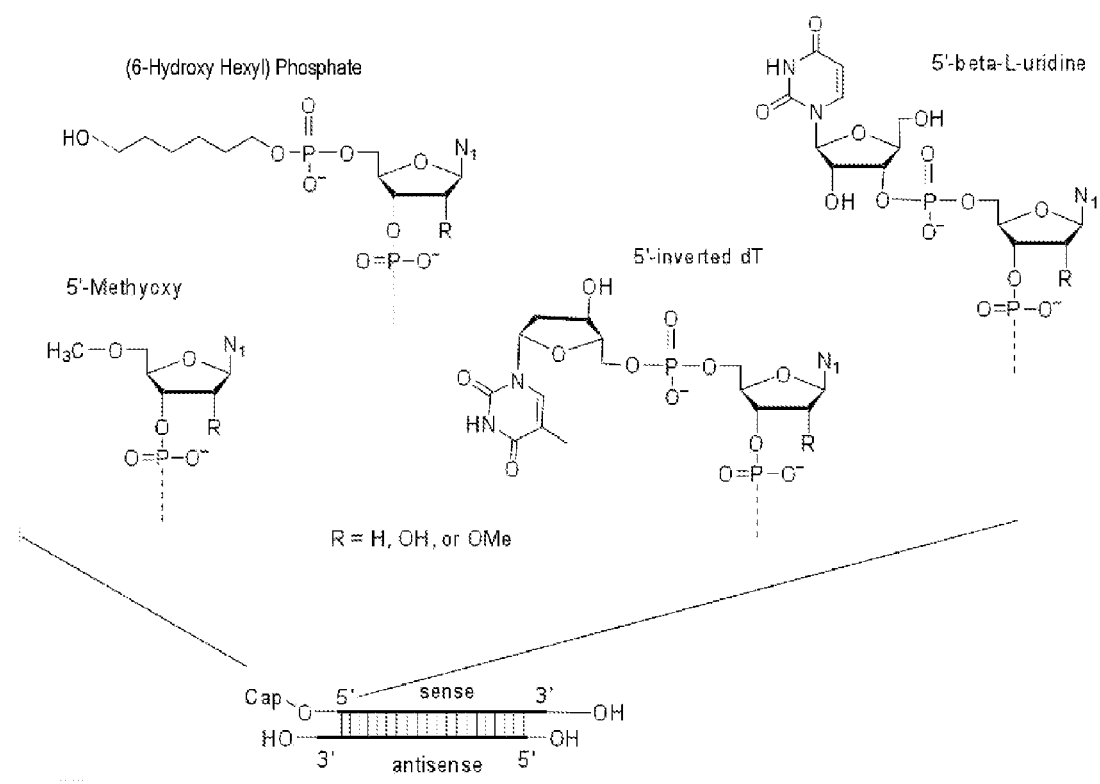

US 8,293,718 B2

ORGANIC COMPOSITIONS TO TREAT HSF1-RELATED DISEASES

This application claims benefit under 35 U.S.C. §119(a)-(d) of U.S. Provisional Application 61/228,137, filed 18 Dec. 2009, the contents of which are incorporated herein by reference in their entirety.

BACKGROUND OF THE INVENTION

HSF1 is the master regulator of the heat shock response, in which multiple genes are induced in response to temperature increase and other stresses. At non-shock temperatures in humans and other vertebrates, HSF1 is produced constitutively, but is inactive and bound by protein HSP90. At an elevated temperature, HSF1 is released by HSP90, moves from the cytoplasm to the nucleus, and trimerizes. This active HSF1 binds to heat shock elements (HSE) in DNA and activates transcription of heat shock genes by RNA polymerase II. The HSE has a consensus sequence of three repeats of NGAAN and is present in the promoter regions of the HSP90, HSP70 and HSP27 genes. During cessation of the heat shock response, HSF1 is phosphorylated by mitogen-activated protein kinases (MAPKs) and glycogen synthase kinase 3 (GSK3) and returns to an inactive state. The biochemistry of HSF1 is described, inter alia, in Chu et al. 1996 J. Biol. Chem. 271:30847-30857; Huang et al. 1997 J. Biol. Chem. 272: 26009-26016; and Morimoto et al. 1998 Nat. Biotech. 16: 833-838.

HSF1 interacts with additional factors. HSF1 binds to DNA-dependent protein kinase (DNA-PK), which is involved in DNA repair. HSF1 is a target of mitogen-activated protein kinases, and its activity is down-regulated when the RAS signaling cascade is active.

Additional heat shock factor proteins in humans include HSF2, HSF3, and HSF4. HSF1, HSF2, and HSF3 are positive regulators of heat shock gene expression, while HSF4 is a negative regulator. HSF1, HSF2 and HSF4 play a role in transcriptional control of other heat shock proteins. The various HSF proteins share about 40% sequence identity.

HSF1 has been implicated in several diseases, including cancer and viral diseases. HSF1 and other heat shock proteins (whose expression is increased by HSF1) are over-expressed in, or have otherwise been implicated in breast, endometrial, fibrosarcoma, gastric, kidney, liver, lung, lymphoma, neuroectodermal, neuroblastoma, Ewing's sarcoma, prostate, skin, squamous cell, and testicular cancers, leukemia (e.g., promyelocytic leukemia), and Hodgkin's disease.

Without wishing to be bound by any particular theory, it is believed that heat shock proteins (HSP) may block the pathways of apoptosis and permit malignant cells to arise despite the triggering of apoptotic signals during transformation. HSP expression may also afford protection to cancer cells from treatments such as chemotherapy and hyperthermia by thwarting the pro-apoptotic influence of these modalities.

Because HSF1 positively regulates HSPs, a need exists for therapeutics that modulate HSF1.

BRIEF DESCRIPTION OF THE DRAWING

FIG. 1 illustrates various 5'-end modifications of RNAi agents to HSF1.

BRIEF SUMMARY OF THE INVENTION

The present disclosure encompasses RNAi agents to HSF1, useful in treatment of HSF1-related disease, such as cancer and viral diseases.

The present disclosure provides RNAi agents directed to the HSF1 (heat shock factor 1) gene. HSF1 is the master regulator of the heat shock response, in which multiple genes are induced in response to temperature increase and other stresses.

HSF1 has been implicated in several HSF1-related diseases, including cancer and viral diseases. HSF1 and other heat shock proteins (whose expression is increased by HSF1) are over-expressed in, or have otherwise been implicated in breast, endometrial, fibrosarcoma, gastric, kidney, liver, lung, lymphoma, neuroectodermal, neuroblastoma, Ewing's sarcoma, prostate, skin, squamous cell, and testicular cancers, leukemia (e.g., promyelocytic leukemia), and Hodgkin's disease.

Because HSF1 positively regulates HSPs, a need exists for therapeutics that modulate HSF1. The RNAi agents of the present disclosure are specific to HSF1 and can reduce expression of HSF1. These RNAi agents are therefore useful in treating cancer and viral diseases.

DETAILED DESCRIPTION OF THE INVENTION

The present disclosure encompasses RNAi agents to HSF1, useful in treatment of HSF1-related disease, such as cancer and viral diseases.

Various Embodiments of the Disclosure Include the Following.

An RNAi Agent Comprising an Antisense Strand of an RNAi Agent Described Herein.

In one embodiment, the present disclosure relates to a composition comprising an RNAi agent comprising an antisense strand, wherein the antisense strand comprises at least 15 contiguous nucleotides differing by 0, 1, 2, or 3 nucleotides from the antisense strand of an RNAi agent to HSF1 selected from any sequence provided in a table herein (e.g., Table 1, Table 2, Table 3, Table 3A, Table 8, Table 9A, Table 9B, etc.). In another embodiment, the present disclosure relates to a composition comprising an RNAi agent comprising a sense strand and an antisense strand, wherein the antisense strand comprises at least 15 contiguous nucleotides differing by 0, 1, 2, or 3 nucleotides from the antisense strand of an RNAi agent to HSF1 from any sequence provided herein. In another embodiment, the present disclosure relates to a composition comprising an RNAi agent comprising a sense strand and an antisense strand, wherein the sense strand comprises at least 15 contiguous nucleotides differing by 0, 1, 2, or 3 nucleotides from the sense strand and the antisense strand comprises at least 15 contiguous nucleotides differing by 0, 1, 2, or 3 nucleotides from the antisense strand of an RNAi agent to HSF1 listed immediately above.

Particular duplexes include the following, wherein each duplex comprises a set of SEQ ID NOs, wherein the first SEQ ID NO corresponds to the sense strand and the second SEQ ID NO corresponds to the antisense strand: AD-20403 (SEQ ID NO: 131 and 643; or SEQ ID NO: 1155 and 1667); AD-20437 (SEQ ID NO: 166 and 678; or SEQ ID NO: 1190 and 1702); AD-20438 (SEQ ID NO: 167 and 679; or SEQ ID NO: 1191 and 1703); AD-20439 (SEQ ID NO: 168 and 680; or SEQ ID NO: 1192 and 1704); AD-20487 (SEQ ID NO: 169 and 681; or SEQ ID NO: 1193 and 1705); AD-20489 (SEQ ID NO: 171 and 683; or SEQ ID NO: 1195 and 1707); AD-20490 (SEQ ID NO: 172 and 684; or SEQ ID NO: 1196 and 1708); AD-20491 (SEQ ID NO: 173 and 685; or SEQ ID NO: 1197 and 1709); AD-20548 (SEQ ID NO: 234 and 746; or SEQ ID NO: 1258 and 1770); AD-20560 (SEQ ID NO: 269 and 781; or SEQ ID NO: 1293 and 1805); AD-20562 (SEQ ID NO: 271 and 783; or SEQ ID NO: 1295 and 1807); AD-20563 (SEQ ID NO: 272 and 784; or SEQ ID NO: 1296 and 1808); AD-20564 (SEQ ID NO: 273 and 785; or SEQ ID NO: 1297 and 1809); AD-20578 (SEQ ID NO: 285 and 797; or SEQ ID NO: 1309 and 1821); AD-20626 (SEQ ID NO: 290 and 802; or SEQ ID NO: 1314 and 1826); AD-20627 (SEQ ID NO: 291 and 803; or SEQ ID NO: 1315 and 1827); AD-20644 (SEQ ID NO: 308 and 820; or SEQ ID NO: 1332 and 1844); AD-20648 (SEQ ID NO: 312 and 824; or SEQ ID NO: 1336 and 1848); AD-20652 (SEQ ID NO: 316 and 828; or SEQ ID NO: 1340 and 1852); AD-20660 (SEQ ID NO: 324 and 836; or SEQ ID NO: 1348 and 1860); AD-20694 (SEQ ID NO: 377 and 889; or SEQ ID NO: 1401 and 1913); AD-20707 (SEQ ID NO: 393 and 905; or SEQ ID NO: 1417 and 1929); AD-20730 (SEQ ID NO: 415 and 927; or SEQ ID NO: 1439 and 1951); AD-20437.4 (SEQ ID NO: 3218 and SEQ ID NO: 3219); AD-20487.7 (SEQ ID NO: 3220 and SEQ ID NO: 3221); AD-20489.2 (SEQ ID NO: 3222 and SEQ ID NO: 3223); AD-20560.4 (SEQ ID NO: 3224 and SEQ ID NO: 3225); AD-37718.1 (SEQ ID NO: 3226 and SEQ ID NO: 3227); AD-37719.1 (SEQ ID NO: 3242 and SEQ ID NO: 3243); AD-37721.1 (SEQ ID NO: 3228 and SEQ ID NO: 3229); AD-37722.1 (SEQ ID NO: 3244 and SEQ ID NO: 3245); AD-37724.1 (SEQ ID NO: 3230 and SEQ ID NO: 3231); AD-37725.1 (SEQ ID NO: 3246 and SEQ ID NO: 3247); AD-37727.1 (SEQ ID NO: 3232 and SEQ ID NO: 3233); AD-37728.1 (SEQ ID NO: 3248 and SEQ ID NO: 3249); AD-37730.1 (SEQ ID NO: 3234 and SEQ ID NO: 3235); AD-37733.1 (SEQ ID NO: 3236 and SEQ ID NO: 3237); AD-37736.1 (SEQ ID NO: 3238 and SEQ ID NO: 3239); AD-37740.1 (SEQ ID NO: 3240 and SEQ ID NO: 3241); AD-36969.2 (SEQ ID NO: 3250 and SEQ ID NO: 3251); AD-30071.2 (SEQ ID NO: 3252 and SEQ ID NO: 3253); AD-36970.2 (SEQ ID NO: 3254 and SEQ ID NO: 3255); AD-37739.1 (SEQ ID NO: 3256 and SEQ ID NO: 3257); AD-37731.1 (SEQ ID NO: 3258 and SEQ ID NO: 3259); AD-37734.1 (SEQ ID NO: 3260 and SEQ ID NO: 3261); AD-37737.1 (SEQ ID NO: 3262 and SEQ ID NO: 3263); AD-37741.1 (SEQ ID NO: 3264 and SEQ ID NO: 3265); AD-37720.1 (SEQ ID NO: 3266 and SEQ ID NO: 3267); AD-37723.1 (SEQ ID NO: 3268 and SEQ ID NO: 3269); AD-37726.1 (SEQ ID NO: 3270 and SEQ ID NO: 3271); AD-37729.1 (SEQ ID NO: 3272 and SEQ ID NO: 3273); AD-37732.1 (SEQ ID NO: 3274 and SEQ ID NO: 3275); AD-37735.1 (SEQ ID NO: 3276 and SEQ ID NO: 3277); AD-37738.1 (SEQ ID NO: 3278 and SEQ ID NO: 3279); AD-37742.1 (SEQ ID NO: 3280 and SEQ ID NO: 3281); AD-20303 (SEQ ID NO: 30 and 542; or SEQ ID NO: 1054 and 1566); AD-20313 (SEQ ID NO: 40 and 552; or SEQ ID NO: 1064 and 1576); AD-20315 (SEQ ID NO: 42 and 554; or SEQ ID NO: 1066 and 1578); AD-20348 (SEQ ID NO: 56 and 568; or SEQ ID NO: 1080 and 1592); AD-20362 (SEQ ID NO: 70 and 582; or SEQ ID NO: 1094 and 1606); AD-20364 (SEQ ID NO: 72 and 584; or SEQ ID NO: 1096 and 1608); AD-20365 (SEQ ID NO: 73 and 585; or SEQ ID NO: 1097 and 1609); AD-20366 (SEQ ID NO: 74 and 586; or SEQ ID NO: 1098 and 1610); AD-20373 (SEQ ID NO: 81 and 593; or SEQ ID NO: 1105 and 1617); AD-20376 (SEQ ID NO: 84 and 596; or SEQ ID NO: 1108 and 1620); AD-20378 (SEQ ID NO: 85 and 597; or SEQ ID NO: 1109 and 1621); AD-20386 (SEQ ID NO: 93 and 605; or SEQ ID NO: 1117 and 1629); AD-20389 (SEQ ID NO: 117 and 629; or SEQ ID NO: 1141 and 1653); AD-20391 (SEQ ID NO: 119 and 631; or SEQ ID NO: 1143 and 1655); AD-20392 (SEQ ID NO: 120 and 632; or SEQ ID NO: 1144 and 1656); AD-20397 (SEQ ID NO: 125 and 637; or SEQ ID NO: 1149 and 1661); AD-20398 (SEQ ID NO: 126 and 638; or SEQ ID NO: 1150 and 1662); AD-20399 (SEQ ID NO: 127 and 639; or SEQ ID NO: 1151 and 1663); AD-20401 (SEQ ID NO: 129 and 641; or SEQ ID NO: 1153 and 1665); AD-20402 (SEQ ID NO: 130 and 642; or SEQ ID NO: 1154 and 1666); AD-20404 (SEQ ID NO: 132 and 644; or SEQ ID NO: 1156 and 1668); AD-20406 (SEQ ID NO: 136 and 648; or SEQ ID NO: 1160 and 1672); AD-20407 (SEQ ID NO: 137 and 649; or SEQ ID NO: 1161 and 1673); AD-20408 (SEQ ID NO: 138 and 650; or SEQ ID NO: 1162 and 1674); AD-20409 (SEQ ID NO: 139 and 651; or SEQ ID NO: 1163 and 1675); AD-20410 (SEQ ID NO: 140 and 652; or SEQ ID NO: 1164 and 1676); AD-20411 (SEQ ID NO: 141 and 653; or SEQ ID NO: 1165 and 1677); AD-20413 (SEQ ID NO: 2042 and 2043; or SEQ ID NO: 2046 and 2047); AD-20422 (SEQ ID NO: 151 and 663; or SEQ ID NO: 1175 and 1687); AD-20428 (SEQ ID NO: 157 and 669; or SEQ ID NO: 1181 and 1693); AD-20434 (SEQ ID NO: 163 and 675; or SEQ ID NO: 1187 and 1699); AD-20435 (SEQ ID NO: 164 and 676; or SEQ ID NO: 1188 and 1700); AD-20488 (SEQ ID NO: 170 and 682; or SEQ ID NO: 1194 and 1706); AD-20493 (SEQ ID NO: 175 and 687; or SEQ ID NO: 1199 and 1711); AD-20495 (SEQ ID NO: 177 and 689; or SEQ ID NO: 1201 and 1713); AD-20502 (SEQ ID NO: 184 and 696; or SEQ ID NO: 1208 and 1720); AD-20507 (SEQ ID NO: 189 and 701; or SEQ ID NO: 1213 and 1725); AD-20513 (SEQ ID NO: 195 and 707; or SEQ ID NO: 1219 and 1731); AD-20527 (SEQ ID NO: 209 and 721; or SEQ ID NO: 1233 and 1745); AD-20535 (SEQ ID NO: 217 and 729; or SEQ ID NO: 1241 and 1753); AD-20544 (SEQ ID NO: 230 and 742; or SEQ ID NO: 1254 and 1766); AD-20545 (SEQ ID NO: 231 and 743; or SEQ ID NO: 1255 and 1767); AD-20546 (SEQ ID NO: 232 and 744; or SEQ ID NO: 1256 and 1768); AD-20547 (SEQ ID NO: 233 and 745; or SEQ ID NO: 1257 and 1769); AD-20549 (SEQ ID NO: 235 and 747; or SEQ ID NO: 1259 and 1771); AD-20552 (SEQ ID NO: 238 and 750; or SEQ ID NO: 1262 and 1774); AD-20555 (SEQ ID NO: 241 and 753; or SEQ ID NO: 1265 and 1777); AD-20556 (SEQ ID NO: 242 and 754; or SEQ ID NO: 1266 and 1778); AD-20557 (SEQ ID NO: 243 and 755; or SEQ ID NO: 1267 and 1779); AD-20558 (SEQ ID NO: 267 and 779; or SEQ ID NO: 1291 and 1803); AD-20561 (SEQ ID NO: 270 and 782; or SEQ ID NO: 1294 and 1806); AD-20565 (SEQ ID NO: 274 and 786; or SEQ ID NO: 1298 and 1810); AD-20566 (SEQ ID NO: 275 and 787; or SEQ ID NO: 1299 and 1811); AD-20572 (SEQ ID NO: 280 and 792; or SEQ ID NO: 1304 and 1816); AD-20574 (SEQ ID NO: 2044 and 2045; or SEQ ID NO: 2048 and 2049); AD-20575 (SEQ ID NO: 282 and 794; or SEQ ID NO: 1306 and 1818); AD-20577 (SEQ ID NO: 284 and 796; or SEQ ID NO: 1308 and 1820); AD-20579 (SEQ ID NO: 286 and 798; or SEQ ID NO: 1310 and 1822); AD-20625 (SEQ ID NO: 289 and 801; or SEQ ID NO: 1313 and 1825); AD-20633 (SEQ ID NO: 297 and 809; or SEQ ID NO: 1321 and 1833); AD-20634 (SEQ ID NO: 298 and 810; or SEQ ID NO: 1322 and 1834); AD-20640 (SEQ ID NO: 304 and 816; or SEQ ID NO: 1328 and 1840); AD-20646 (SEQ ID NO: 310 and 822; or SEQ ID NO: 1334 and 1846); AD-20650 (SEQ ID NO: 314 and 826; or SEQ ID NO: 1338 and 1850); AD-20653 (SEQ ID NO: 317 and 829; or SEQ ID NO: 1341 and 1853); AD-20661 (SEQ ID NO: 325 and 837; or SEQ ID NO: 1349 and 1861); AD-20671 (SEQ ID NO: 337 and 849; or SEQ ID NO: 1361 and 1873); AD-20693 (SEQ ID NO: 376 and 888; or SEQ ID NO: 1400 and 1912); AD-20700 (SEQ ID NO: 383 and 895; or SEQ ID NO: 1407 and 1919); AD-20702 (SEQ ID NO: 385 and 897; or SEQ ID NO: 1409 and 1921); AD-20709 (SEQ ID NO: 394 and 906; or SEQ ID NO: 1418 and 1930); AD-20710 (SEQ ID NO: 395 and 907; or SEQ ID NO: 1419 and 1931); AD-20714 (SEQ ID NO: 399 and 911; or SEQ ID NO: 1423 and 1935); AD-20716 (SEQ ID NO: 401 and 913; or SEQ ID NO: 1425 and 1937); AD-20728 (SEQ ID NO: 413 and 925; or SEQ ID NO: 1437 and 1949); AD-20741 (SEQ ID NO: 429 and 941;

or SEQ ID NO: 1453 and 1965); AD-20764 (SEQ ID NO: 452 and 964; or SEQ ID NO: 1476 and 1988); AD-20783 (SEQ ID NO: 471 and 983; or SEQ ID NO: 1495 and 2007); AD-20278 (SEQ ID NOs: 2053 and 2064; or SEQ ID NOs: 2075 and 2086); AD-20279 (SEQ ID NOs: 2054 and 2065; or SEQ ID NOs: 2076 and 2087); AD-20280 (SEQ ID NOs: 2055 and 2066; or SEQ ID NOs: 2077 and 2088); AD-20281 (SEQ ID NOs: 2056 and 2067; or SEQ ID NOs: 2078 and 2089); AD-20282 (SEQ ID NOs: 2057 and 2068; or SEQ ID NOs: 2079 and 2090); AD-20283 (SEQ ID NOs: 2058 and 2069; or SEQ ID NOs: 2080 and 2091); AD-20377 (SEQ ID NOs: 2059 and 2070; or SEQ ID NOs: 2081 and 2092); AD-20570 (SEQ ID NOs: 2060 and 2071; or SEQ ID NOs: 2082 and 2093); AD-20580 (SEQ ID NOs: 2061 and 2072; or SEQ ID NOs: 2083 and 2094); AD-20597 (SEQ ID NOs: 2062 and 2073; or SEQ ID NOs: 2084 and 2095); and AD-20598 (SEQ ID NOs: 2063 and 2074; or SEQ ID NOs: 2085 and 2096). These example duplexes and the SEQ ID NOs for the specific sense strand (SS) and antisense strand (AS) are provided herein with their nucleotide sequence, e.g., as listed within Table 1, Table 2, Table 3, Table 3A, Table 8, Table 9A and Table 9B. Modified sequences (e.g., sequences comprising one or more chemically modified base) of each of the compositions above and each of the RNAi agents in Tables 1, 2, 3, 3A, 8, 9A and 9B are also contemplated as part of the disclosure.

Particular Compositions

In one embodiment, the present disclosure relates to particular compositions comprising an RNAi agent comprising an antisense strand, wherein the antisense strand comprises at least 15 contiguous nucleotides differing by 0, 1, 2, or 3 nucleotides from the antisense strand of an RNAi agent to HSF1 selected from any one or more of the sequences in Tables 1, 2, 3, 3A, 8, 9A and 9B. In another embodiment, the present disclosure relates to a composition comprising an RNAi agent comprising a sense strand and an antisense strand, wherein the antisense strand comprises at least 15 contiguous nucleotides differing by 0, 1, 2, or 3 nucleotides from the antisense strand of an RNAi agent to HSF1 listed in any one or more of Tables 1, 2, 3, 3A, 8, 9A and 9B. In another embodiment, the present disclosure relates to a composition comprising an RNAi agent comprising a sense strand and an antisense strand, wherein the sense strand comprises at least 15 contiguous nucleotides differing by 0, 1, 2, or 3 nucleotides from the sense strand and the antisense strand comprises at least 15 contiguous nucleotides differing by 0, 1, 2, or 3 nucleotides from the antisense strand of an RNAi agent to HSF1 listed immediately above. Particular duplexes include those specific duplexes provided above and as listed in any one or more of Table 1, Table 2, Table 3, Table 3A, Table 8, Table 9A and Table 9B. Additional modified sequences (e.g., sequences comprising one or more modified base) of each of the compositions above are also contemplated as part of the disclosure.

TABLE A1

SEQ ID NOs for Sense Strand (SS) and Antisense Strand (AS) for RNAi agents of the invention.

| RNAi agent | SEQ ID NO: Strand: | | | |
|---|---|---|---|---|
|  | SS | AS | SS | AS |
| AD-20403 | 131 | 643 | 1155 | 1667 |
| AD-20437 | 166 | 678 | 1190 | 1702 |
| AD-20438 | 167 | 679 | 1191 | 1703 |

TABLE A1-continued

SEQ ID NOs for Sense Strand (SS) and Antisense Strand (AS) for RNAi agents of the invention.

| RNAi agent | SEQ ID NO: Strand: | | | |
|---|---|---|---|---|
|  | SS | AS | SS | AS |
| AD-20439 | 168 | 680 | 1192 | 1704 |
| AD-20487 | 169 | 681 | 1193 | 1705 |
| AD-20489 | 171 | 683 | 1195 | 1707 |
| AD-20490 | 172 | 684 | 1196 | 1708 |
| AD-20491 | 173 | 685 | 1197 | 1709 |
| AD-20548 | 234 | 746 | 1258 | 1770 |
| AD-20560 | 269 | 781 | 1293 | 1805 |
| AD-20562 | 271 | 783 | 1295 | 1807 |
| AD-20563 | 272 | 784 | 1296 | 1808 |
| AD-20564 | 273 | 785 | 1297 | 1809 |
| AD-20578 | 285 | 797 | 1309 | 1821 |
| AD-20626 | 290 | 802 | 1314 | 1826 |
| AD-20627 | 291 | 803 | 1315 | 1827 |
| AD-20644 | 308 | 820 | 1332 | 1844 |
| AD-20648 | 312 | 824 | 1336 | 1848 |
| AD-20652 | 316 | 828 | 1340 | 1852 |
| AD-20660 | 324 | 836 | 1348 | 1860 |
| AD-20694 | 377 | 889 | 1401 | 1913 |
| AD-20707 | 393 | 905 | 1417 | 1929 |
| AD-20730 | 415 | 927 | 1439 | 1951 |
| AD-20437.4 | 3218 | 3219 |  |  |
| AD-20487.7 | 3220 | 3221 |  |  |
| AD-20489.2 | 3222 | 3223 |  |  |
| AD-20560.4 | 3224 | 3225 |  |  |
| AD-37718.1 | 3226 | 3227 |  |  |
| AD-37719.1 | 3242 | 3243 |  |  |
| AD-37721.1 | 3228 | 3229 |  |  |
| AD-37722.1 | 3244 | 3245 |  |  |
| AD-37724.1 | 3230 | 3231 |  |  |
| AD-37725.1 | 3246 | 3247 |  |  |
| AD-37727.1 | 3232 | 3233 |  |  |
| AD-37728.1 | 3248 | 3249 |  |  |
| AD-37730.1 | 3234 | 3235 |  |  |
| AD-37733.1 | 3236 | 3237 |  |  |
| AD-37736.1 | 3238 | 3239 |  |  |
| AD-37740.1 | 3240 | 3241 |  |  |
| AD-36969.2 | 3250 | 3251 |  |  |
| AD-30071.2 | 3252 | 3253 |  |  |
| AD-36970.2 | 3254 | 3255 |  |  |
| AD-37739.1 | 3256 | 3257 |  |  |
| AD-37731.1 | 3258 | 3259 |  |  |
| AD-37734.1 | 3260 | 3261 |  |  |
| AD-37737.1 | 3262 | 3263 |  |  |
| AD-37741.1 | 3264 | 3265 |  |  |
| AD-37720.1 | 3266 | 3267 |  |  |
| AD-37723.1 | 3268 | 3269 |  |  |
| AD-37726.1 | 3270 | 3271 |  |  |
| AD-37729.1 | 3272 | 3273 |  |  |
| AD-37732.1 | 3274 | 3275 |  |  |
| AD-37735.1 | 3276 | 3277 |  |  |
| AD-37738.1 | 3278 | 3279 |  |  |
| AD-37742.1 | 3280 | 3281 |  |  |
| AD-20303 | 30 | 542 | 1054 | 1566 |
| AD-20313 | 40 | 552 | 1064 | 1576 |
| AD-20315 | 42 | 554 | 1066 | 1578 |
| AD-20348 | 56 | 568 | 1080 | 1592 |
| AD-20362 | 70 | 582 | 1094 | 1606 |
| AD-20364 | 72 | 584 | 1096 | 1608 |
| AD-20365 | 73 | 585 | 1097 | 1609 |
| AD-20366 | 74 | 586 | 1098 | 1610 |
| AD-20373 | 81 | 593 | 1105 | 1617 |
| AD-20376 | 84 | 596 | 1108 | 1620 |
| AD-20378 | 85 | 597 | 1109 | 1621 |
| AD-20386 | 93 | 605 | 1117 | 1629 |
| AD-20389 | 117 | 629 | 1141 | 1653 |
| AD-20391 | 119 | 631 | 1143 | 1655 |
| AD-20392 | 120 | 632 | 1144 | 1656 |
| AD-20397 | 125 | 637 | 1149 | 1661 |
| AD-20398 | 126 | 638 | 1150 | 1662 |
| AD-20399 | 127 | 639 | 1151 | 1663 |
| AD-20401 | 129 | 641 | 1153 | 1665 |
| AD-20402 | 130 | 642 | 1154 | 1666 |

TABLE A1-continued

SEQ ID NOs for Sense Strand (SS) and Antisense Strand (AS) for RNAi agents of the invention.

| RNAi agent | SS | AS | SS | AS |
|---|---|---|---|---|
| AD-20404 | 132 | 644 | 1156 | 1668 |
| AD-20406 | 136 | 648 | 1160 | 1672 |
| AD-20407 | 137 | 649 | 1161 | 1673 |
| AD-20408 | 138 | 650 | 1162 | 1674 |
| AD-20409 | 139 | 651 | 1163 | 1675 |
| AD-20410 | 140 | 652 | 1164 | 1676 |
| AD-20411 | 141 | 653 | 1165 | 1677 |
| AD-20413 | 2042 | 2043 | 2046 | 2047 |
| AD-20422 | 151 | 663 | 1175 | 1687 |
| AD-20428 | 157 | 669 | 1181 | 1693 |
| AD-20434 | 163 | 675 | 1187 | 1699 |
| AD-20435 | 164 | 676 | 1188 | 1700 |
| AD-20488 | 170 | 682 | 1194 | 1706 |
| AD-20493 | 175 | 687 | 1199 | 1711 |
| AD-20495 | 177 | 689 | 1201 | 1713 |
| AD-20502 | 184 | 696 | 1208 | 1720 |
| AD-20507 | 189 | 701 | 1213 | 1725 |
| AD-20513 | 195 | 707 | 1219 | 1731 |
| AD-20527 | 209 | 721 | 1233 | 1745 |
| AD-20535 | 217 | 729 | 1241 | 1753 |
| AD-20544 | 230 | 742 | 1254 | 1766 |
| AD-20545 | 231 | 743 | 1255 | 1767 |
| AD-20546 | 232 | 744 | 1256 | 1768 |
| AD-20547 | 233 | 745 | 1257 | 1769 |
| AD-20549 | 235 | 747 | 1259 | 1771 |
| AD-20552 | 238 | 750 | 1262 | 1774 |
| AD-20555 | 241 | 753 | 1265 | 1777 |
| AD-20556 | 242 | 754 | 1266 | 1778 |
| AD-20557 | 243 | 755 | 1267 | 1779 |
| AD-20558 | 267 | 779 | 1291 | 1803 |
| AD-20561 | 270 | 782 | 1294 | 1806 |
| AD-20565 | 274 | 786 | 1298 | 1810 |
| AD-20566 | 275 | 787 | 1299 | 1811 |
| AD-20572 | 280 | 792 | 1304 | 1816 |
| AD-20574 | 2044 | 2045 | 2048 | 2049 |
| AD-20575 | 282 | 794 | 1306 | 1818 |
| AD-20577 | 284 | 796 | 1308 | 1820 |
| AD-20579 | 286 | 798 | 1310 | 1822 |
| AD-20625 | 289 | 801 | 1313 | 1825 |
| AD-20633 | 297 | 809 | 1321 | 1833 |
| AD-20634 | 298 | 810 | 1322 | 1834 |
| AD-20640 | 304 | 816 | 1328 | 1840 |
| AD-20646 | 310 | 822 | 1334 | 1846 |
| AD-20650 | 314 | 826 | 1338 | 1850 |
| AD-20653 | 317 | 829 | 1341 | 1853 |
| AD-20661 | 325 | 837 | 1349 | 1861 |
| AD-20671 | 337 | 849 | 1361 | 1873 |
| AD-20693 | 376 | 888 | 1400 | 1912 |
| AD-20700 | 383 | 895 | 1407 | 1919 |
| AD-20702 | 385 | 897 | 1409 | 1921 |
| AD-20709 | 394 | 906 | 1418 | 1930 |
| AD-20710 | 395 | 907 | 1419 | 1931 |
| AD-20714 | 399 | 911 | 1423 | 1935 |
| AD-20716 | 401 | 913 | 1425 | 1937 |
| AD-20728 | 413 | 925 | 1437 | 1949 |
| AD-20741 | 429 | 941 | 1453 | 1965 |
| AD-20764 | 452 | 964 | 1476 | 1988 |
| AD-20783 | 471 | 983 | 1495 | 2007 |
| AD-20278 | 2053 | 2064 | 2075 | 2086 |
| AD-20279 | 2054 | 2065 | 2076 | 2087 |
| AD-20280 | 2055 | 2066 | 2077 | 2088 |
| AD-20281 | 2056 | 2067 | 2078 | 2089 |
| AD-20282 | 2057 | 2068 | 2079 | 2090 |
| AD-20283 | 2058 | 2069 | 2080 | 2091 |
| AD-20377 | 2059 | 2070 | 2081 | 2092 |
| AD-20570 | 2060 | 2071 | 2082 | 2093 |
| AD-20580 | 2061 | 2072 | 2083 | 2094 |
| AD-20597 | 2062 | 2073 | 2084 | 2095 |
| AD-20598 | 2063 | 2074 | 2085 | 2096 |

An RNAi Agent Comprising an Antisense Strand of an RNAi Agent Described Herein.

In one particular specific embodiment, the present disclosure relates to a composition comprising an RNAi agent comprising an antisense strand, wherein the antisense strand comprises at least 15 contiguous nucleotides differing by 0, 1, 2, or 3 nucleotides from the antisense strand of an RNAi agent to HSF1 selected from those antisense strands in the specific duplexes provided above and as listed in Table 1, Table 2, Table 3, Table 3A, Table 8, Table 9A, and Table 9B.

Various particular specific embodiments of this embodiment are described below.

In one embodiment, the composition further comprises a second RNAi agent to HSF1. In various embodiments, the second RNAi agent is physically separate from the first, or the two are physically connected (e.g., covalently linked or otherwise conjugated).

In one embodiment, the antisense strand is about 30 or fewer nucleotides in length.

In one embodiment, the antisense strand forms a duplex region with a sense strand, wherein the duplex region is about 15 to 30 nucleotide pairs in length.

In one embodiment, the antisense strand is about 15 to about 30 nucleotides in length, including about 19 to about 23 nucleotides in length. In one embodiment, the antisense strand has at least the length selected from about 15 nucleotides, about 16 nucleotides, about 17 nucleotides, about 18 nucleotides, about 19 nucleotides, about 20 nucleotides, about 21 nucleotides, about 22 nucleotides, about 23 nucleotides, about 24 nucleotides, about 25 nucleotides, about 26 nucleotides, about 27 nucleotides, about 28 nucleotides, about 29 nucleotides and 30 nucleotides.

In one embodiment, the RNAi agent comprises a modification that causes the RNAi agent to have increased stability in a biological sample or environment.

In one embodiment, the RNAi agent comprises at least one sugar backbone modification (e.g., phosphorothioate linkage) or at least one 2'-modified nucleotide.

In one embodiment, the RNAi agent comprises: at least one 5'-uridine-adenine-3' (5'-ua-3') dinucleotide, wherein the uridine is a 2'-modified nucleotide; at least one 5'-uridine-guanine-3' (5'-ug-3') dinucleotide, wherein the 5'-uridine is a 2'-modified nucleotide; at least one 5'-cytidine-adenine-3' (5'-ca-3') dinucleotide, wherein the 5'-cytidine is a 2'-modified nucleotide; or at least one 5'-uridine-uridine-3' (5'-uu-3') dinucleotide, wherein the 5'-uridine is a 2'-modified nucleotide. These dinucleotide motifs are particularly prone to serum nuclease degradation (e.g. RNase A). Chemical modification at the 2'-position of the first pyrimidine nucleotide in the motif prevents or slows down such cleavage. This modification recipe is also known under the term 'endo light'.

In one embodiment, the RNAi agent comprises a 2"-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2"-O—N-methylacetamido (2'-O—NMA). In one embodiment, all pyrimidines (uridine and cytidine) are 2' O-methyl-modified nucleosides.

In one embodiment, the RNAi agent comprises at least one blunt end.

In one embodiment, the RNAi agent comprises an overhang having 1 nt to 4 nt unpaired.

In one embodiment, the RNAi agent comprises an overhang at the 3'-end of the antisense strand of the RNAi agent.

In one embodiment, the RNAi agent is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

In one embodiment, the RNAi agent is capable of inhibiting expression of HSF1 by at least about 60% in WI-38 and/or HeLa cells in vitro.

In one embodiment, the RNAi agent is capable of inhibiting expression of HSF1 by at least about 70% in WI-38 and/or HeLa cells in vitro.

In one embodiment, the RNAi agent is capable of inhibiting expression of HSF1 by at least about 75% in WI-38 and/or HeLa cells in vitro.

In one embodiment, the RNAi agent is capable of inhibiting expression of HSF1 by at least about 80% in WI-38 and/or HeLa cells in vitro.

In one embodiment, the RNAi agent is capable of inhibiting expression of HSF1 by at least about 90% in WI-38 and/or HeLa cells in vitro.

In one embodiment, the RNAi agent is capable of inhibiting expression of HSF1 by at least about 95% in WI-38 and/or HeLa cells in vitro.

In one embodiment, the RNAi agent is capable of inhibiting expression of HSF1 by at least about 99% in WI-38 and/or HeLa cells in vitro.

In one embodiment, the RNAi has an EC50 of no more than about 0.1 nM. EC50 is effective concentration to reduce gene expression by 50%.

In one embodiment, the RNAi has an EC50 of no more than about 0.01 nM.

In one embodiment, the RNAi has an EC50 of no more than about 0.001 nM.

An RNAi Agent Comprising a Sense and Antisense Strand of an RNAi Described Herein.

In one particular specific embodiment, the present disclosure relates to a composition comprising an RNAi agent comprising a sense strand and an antisense strand, wherein the sense strand and antisense strand comprise at least 15 contiguous nucleotides differing by 0, 1, 2, or 3 nucleotides, from the sense and antisense strand, respectively, of an RNAi agent to HSF1 selected from the specific duplexes provided above and as listed in Table 1, Table 2, Table 3, Table 3A, Table 8, Table 9A, and Table 9B.

Various particular specific embodiments of this embodiment are described below.

In one embodiment, the composition comprises a second RNAi agent to HSF1. In various embodiments, the second RNAi agent is physically separate from the first, or the two are physically connected (e.g., chemically linked or otherwise conjugated).

In one embodiment, the antisense strand is about 30 or fewer nucleotides in length.

In one embodiment, the sense strand and the antisense strand form a duplex region about 15 to about 30 nucleotide pairs in length.

In one embodiment, the antisense strand and the sense strand are both about 19 to about 23 nt in length.

In one embodiment, the RNAi agent comprises a modification that causes the RNAi agent to have increased stability in a biological sample or environment.

In one embodiment, the RNAi agent comprises a modified sugar backbone such as, e.g., a phosphorothioate linkage, or comprises a 2'-modified nucleotide.

In one embodiment, the RNAi agent comprises: at least one 5'-uridine-adenine-3' (5'-ua-3') dinucleotide, wherein the uridine is a 2'-modified nucleotide; at least one 5'-uridine-guanine-3' (5'-ug-3') dinucleotide, wherein the 5'-uridine is a 2'-modified nucleotide; at least one 5'-cytidine-adenine-3' (5'-ca-3') dinucleotide, wherein the 5'-cytidine is a 2'-modified nucleotide; or at least one 5'-uridine-uridine-3' (5'-uu-3') dinucleotide, wherein the 5'-uridine is a 2'-modified nucleotide.

In one embodiment, the RNAi agent comprises a 2'-modification selected from the group consisting of: 2'-deoxy, 2'-deoxy-2'-fluoro, 2'-O-methyl, 2''-O-methoxyethyl (2'-O-MOE), 2'-O-aminopropyl (2'-O-AP), 2'-O-dimethylaminoethyl (2'-O-DMAOE), 2''-O-dimethylaminopropyl (2'-O-DMAP), 2'-O-dimethylaminoethyloxyethyl (2'-O-DMAEOE), and 2'-O—N-methylacetamido (2'-O—NMA).

In one embodiment, all pyrimidines (uridine and cytidine) are 2' O-methyl-modified nucleosides.

In one embodiment, the RNAi agent comprises at least one blunt end.

In one embodiment, the RNAi agent comprises an overhang having 1 to 4 nt unpaired.

In one embodiment, the RNAi agent comprises an overhang at the 3'-end of the antisense strand of the RNAi agent.

In one embodiment, the RNAi agent is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

In one embodiment, the RNAi agent is capable of inhibiting expression of HSF1 by at least about 60% in WI-38 and/or HeLa cells in vitro.

In one embodiment, the RNAi agent is capable of inhibiting expression of HSF1 by at least about 70% in WI-38 and/or HeLa cells in vitro.

In one embodiment, the RNAi agent is capable of inhibiting expression of HSF1 by at least about 80% in WI-38 and/or HeLa cells in vitro.

In one embodiment, the RNAi agent is capable of inhibiting expression of HSF1 by at least about 90% in WI-38 and/or HeLa cells in vitro.

In one embodiment, the RNAi agent is capable of inhibiting expression of HSF1 by at least about 95% in WI-38 and/or HeLa cells in vitro.

In one embodiment, the RNAi agent is capable of inhibiting expression of HSF1 by at least about 99% in WI-38 and/or HeLa cells in vitro.

In one embodiment, the RNAi has an EC50 of no more than about 0.1 nM.

In one embodiment, the RNAi has an EC50 of no more than about 0.01 nM.

In one embodiment, the RNAi has an EC50 of no more than about 0.001 nM.

A Method of Treatment Using an RNAi Agent Comprising a RNAi Agent Described Herein.

In one particular specific embodiment, the present disclosure relates to a method of treating a HSF1-related disease in an individual, comprising the step of administering to the individual a therapeutically effective amount of a composition comprising an RNAi agent comprising an antisense strand, wherein the antisense strand comprises at least 15 contiguous nucleotides differing by 0, 1, 2, or 3 nucleotides from the antisense strand of an RNAi agent to HSF1 selected from those specific duplexes provided above and as listed in Table 1, Table 2, Table 3, Table 3A, Table 8, Table 9A and Table 9B. In one embodiment, the RNAi agent to HSF1 comprises an antisense strand duplexed with a sense strand, wherein the sense and antisense strands are selected from one or more of the sequences provided in Table 1, Table 2, Table 3, Table 3A, Table 8, Table 9A or Table 9.

Various particular specific embodiments of this embodiment are described below.

In one embodiment, the HSF1-related disease is proliferative disease such as, e.g., a cancer, or is an autoimmune disease, or is a viral disease.

In one embodiment, the HSF1-related disease is cancer selected from the list of bladder, bone, breast, cervical, colon, colorectal, endometrial, fibrosarcoma, gastric, haematopoietic, intestine, kidney, liver, lung, lymphoma, neuroectodermal, neuroblastoma, Ewing's sarcoma, osteosarcoma, ovary, pancreas, pleura, prostate, skin, squamous cell, stomach, and testicular cancers, leukemia, promyelocytic leukemia, and Hodgkin's disease.

In one embodiment, the method further comprises the step of administering an additional cancer treatment.

In one embodiment, the method further comprises the step of administering an additional cancer treatment selected from the list of actinomycin D, an inhibitor of HSP90 (heat shock protein 90), 17-AAG (tanespimycin), 17-DMAG (alvespimycin), IPI-504 (retaspimycin), IPI-493, SNX-5422 mesylate, AUY922, BIB021 CNF-2024, BIIB028, STA-9090, KW-2478, ATI3387, XL888, HSP990, MPC-3100, ABI-010 (as reviewed in Kim et al. 2009 Curr. Topics in Med. Chem. 9: 1479-1492), or 2-chlorodeoxyadenosine, 5-azacitidine, 5-fluoro-29-deoxyuridine, 5-fluorouracil, 6-mercaptopurine, 6-thioguanine, 7-hydroxystaurosporine, 13-cis-retinoic acid, a goserlin implant, alemtuzumab, alitretinoin, all-trans retinoic acid, alpha interferon, altretamine, amifostine, aminoglutethimide, anagrelide, anastrozole, arabinosylcytosine, arsenic trioxide, asparaginase, bacillus calmette-guerin, bendamustine, bevacizumab, bexarotene, bicalutamide, bleomycin, bortezomib, busulfan, camptothecin, capecitabine, carboplatin, carmustine, cetuximab, chlorambucil, cisplatin, cladribine, colcemid, Cycloheximide, cyclophosphamide, cytarabine, cytosine arabinoside (Ara-C), dacarbazine, dactinomycin, dasatinib, daunorubicin liposomal, daunorubicin, decitabine, denileukin diftitox, dexamethazone, docetaxel, doxorubicin, edelfosine, ehlorambucil, epipodophyllotoxin, epirubicin, erlotinib, estramustine, etoposide, everolimus, exemestane, fenretinide, finasteride, flavopiridol, floxuridine, fludarabine, fluorouracil, fluoxymesterone, flutamide, fulvestrant, gefitinib, gemcitabine, gemtuzumab ozogamicin, goserelin, hexamethylmelamine, hydrocortisone, hydroxyurea, ibritumomab tiuxetan, ibtritumomab, idarubicin, ifosfamide, imatinib, imidazole carboxamide, interleukin-11, interleukin-2, irinotecan, ixabepilone, lapatinib, L-asparaginase, lenalidomide, letrozole, leukovorin, leuprolide, mechlorethamine, megestrol, melphalan, mercaptopurine, methotrexate, methylprednisolone, mitixantrone, mitomycin, mitoxantrone, nelarabine, nitrogen mustard, octreotide, oxaliplatin, paclitaxel, paclitaxel-albumin formulations, paclitaxel-protein formulations, pamidronate, panitumumab, pemetrexed, pentostatin, phenylalanine mustard, pirubicin, prednisolone, prednisone, procarbazine, Puromycin, raloxifene, rituxan, rubidomycin, sargramostim, sorafenib, staurosporine, steroids, streptozocin, sunitinib, tamoxifen, Taxol, tegafur, temozolomide, temsirolimus, teniposide, thalidomide, thiophosphoamide, thiotepa, topotecan, toremifene, tositumomab, trastuzumab, tretinoin, UFT, vinblastine, vincristine, vinorelbine, vorinostat, and/or zoledronic acid. A RNAi agent to HSF1 can be used in conjunction with any additional treatment disclosed herein, as appropriate for the disease, optionally, in further conjunction with one or more additional RNAi agents to HSF1.

In one embodiment, the HSF1-related disease is a viral disease.

In one embodiment, the HSF1-related disease is a viral disease selected from the list of viral diseases mediated in whole or in part by adenovirus, herpes simplex virus, human cytomegalovirus, HTLV-1, SV40, polyoma virus, HIV, and/or Epstein-Barr virus.

In one embodiment, the method further comprises the step of administering an additional viral disease treatment.

In one embodiment, the method further comprises the step of administering an additional viral disease treatment selected from the list of Abacavir, Aciclovir, acyclovir (acycloguanosine), Adefovir, Amantadine, Ampligen, Amprenavir, Arbidol, Atazanavir, Atripla, bevirimat, Boceprevir, broad spectrum inhibitor, Cidofovir, Combivir, Darunavir, Delavirdine, Didanosine, Docosanol, Edoxudine, Efavirenz, Emtricitabine, Enfuvirtide, Entecavir, Entry inhibitors, Entry or fusion inhibitor, Famciclovir, Fomivirsen, Fos amprenavir, Foscarnet, Fosfonet, Fusion inhibitor, Ganciclovir, Ibacitabine, Idoxuridine, Imiquimod, Immunovir, Indinavir, Inosine, Integrase inhibitor, Integrase inhibitor, Interferon, Interferon type I, Interferon type II, Interferon type III, Lamivudine, Lopinavir, Loviride, Maraviroc, Maturation inhibitor, Moroxydine, Nelfinavir, Nevirapine, Nexavir, Non-nucleoside reverse transcriptase inhibitor, NOV-205, Nucleoside analogues, Nucleotide analog reverse transcriptase inhibitor, Oseltamivir (Tamiflu), Peginterferon alfa-2a, Penciclovir, Peramivir, Pleconaril, Podophyllotoxin, Protease inhibitor, Protease inhibitor, Raltegravir, Raltegravir, Reverse transcriptase inhibitor, Reverse transcriptase inhibitor, Ribavirin, Rimantadine, Ritonavir, Saquinavir, Saquinavir, Stavudine, Synergistic enhancer (antiretroviral), Tenofovir, Tenofovir disoproxil, Tipranavir, Trifluridine, Trizivir, Tromantadine, Truvada, Valaciclovir (Valtrex), Valganciclovir, Vicriviroc, Vidarabine, Viramidine, Zalcitabine, Zanamivir (Relenza), and Zidovudine. It will be understood that references to any additional treatment (e.g., viral disease treatment or cancer treatment or autoimmune disease treatment, etc.) are meant to also include the pharmaceutically acceptable salts of any of the active substances. If active substances comprised by components (a) and/or (b) have, for example, at least one basic center, they can form acid addition salts. Corresponding acid addition salts can also be formed having, if desired, an additionally present basic center. Active substances having an acid group, e.g., COOH, can form salts with bases. The active substances comprised in components (a) and/or (b) or a pharmaceutically acceptable salts thereof may also be used in form of a hydrate or include other solvents used for crystallization.

In one embodiment, the HSF1-related disease is an autoimmune disease.

In one embodiment, the HSF1-related disease is lupus or rheumatoid arthritis.

In one embodiment, the composition comprises a second RNAi agent to HSF1. In various embodiments, the second RNAi agent is physically distinct from the first, or the two are physically connected (e.g., linked or conjugated).

A Method of Inhibiting the Expression of HSF1, Using an RNAi Comprising an RNAi Agent Described Herein.

In one particular specific embodiment, the present disclosure relates to a method of inhibiting the expression of HSF1 in an individual, comprising the step of administering to the individual a therapeutically effective amount of a composition comprising an RNAi agent of the disclosure. In one embodiment, the RNAi comprises a sense strand and an antisense strand, wherein the antisense strand comprises at least 15 contiguous nucleotides differing by 0, 1, 2, or 3 nucleotides from the antisense strand of an RNAi agent to HSF1 selected from those specific duplexes provided above and as listed in Table 1, Table 2, Table 3, Table 3A, Table 8, Table 9A, and Table 9B.

Various particular specific embodiments of this embodiment are described below.

In one embodiment, the individual is afflicted with or susceptible to an HSF1-related disease.

In one embodiment, the HSF1-related disease is proliferative disease, such as, e.g., a cancer.

In one embodiment, the HSF1-related disease is cancer selected from the list of bladder, bone, breast, cervical, colon, colorectal, endometrial, fibrosarcoma, gastric, haematopoietic, intestine, kidney, liver, lung, lymphoma, neuroectodermal, neuroblastoma, Ewing's sarcoma, osteosarcoma, ovary, pancreas, pleura, prostate, skin, squamous cell, stomach, and testicular cancers, leukemia, promyelocytic leukemia, and Hodgkin's disease.

In one embodiment, the method further comprises the step of administering an additional cancer treatment.

In one embodiment, the method further comprises the step of administering an additional cancer treatment selected from the list of any cancer treatment listed herein, or known in the art.

In one embodiment, the HSF1-related disease is a viral disease.

In one embodiment, the HSF1-related disease is a viral disease selected from the list of viral diseases mediated in whole or in part by adenovirus, herpes simplex virus, human cytomegalovirus, HTLV-1, SV40, polyoma virus, HIV, and/or Epstein-Barr virus.

In one embodiment, the method further comprises the step of administering an additional viral disease treatment.

In one embodiment, the method further comprises the step of administering an additional viral disease treatment selected from the list of any viral disease treatment listed herein.

In one embodiment, the HSF1-related disease is an autoimmune disease.

In one embodiment, the HSF1-related disease is lupus or rheumatoid arthritis.

In one embodiment, the composition further comprises a second RNAi agent to HSF1. In various embodiments, the second RNAi agent is physically distinct from the first, or the two are physically connected (e.g., linked or conjugated).

OTHER EMBODIMENTS

Various particular specific embodiments of this disclosure are described below.

In one embodiment, the disclosure pertains to a composition according to any of the above embodiments, for use in a method of treating a HSF1-related disease in an individual, the method comprising the step of administering to the individual a therapeutically effective amount of a composition according to any of the claims.

Various particular specific embodiments of this embodiment are described below.

In one embodiment, the disclosure pertains to the composition according to any of the above embodiments, for use in a method of inhibiting the expression of HSF1 in an individual, the method comprising the step of administering to the individual a therapeutically effective amount of a composition according to any of the above embodiments.

One embodiment of the disclosure is the use of a composition according to any of the above embodiments, in the manufacture of a medicament for treatment of an HSF1-related disease.

In one embodiment, the HSF1-related disease is selected from cancer, viral disease or autoimmune disease.

In one embodiment, the disclosure pertains to the composition of any of the above embodiments, for use in the treatment of an HSF1-related disease.

In one embodiment, the HSF1-related disease is selected from cancer, viral disease or autoimmune disease.

In one embodiment, the disclosure relates to a method of inhibiting the expression of HSF1 in an cell, comprising the step of introducing into the cell a composition comprising an RNAi agent comprising an antisense strand, wherein the antisense strand comprises at least 15 contiguous nucleotides differing by 0, 1, 2, or 3 nucleotides from the antisense strand of an RNAi agent to HSF1 selected from the HSF1 siRNAs disclosed herein.

In one embodiment, the disclosure relates to a method of inhibiting the expression of HSF1 in an cell, comprising the step of introducing into the cell a composition comprising an RNAi agent comprising a sense strand and an antisense strand, wherein the antisense strand comprises at least 15 contiguous nucleotides differing by 0, 1, 2, or 3 nucleotides from the antisense strand, and the sense strand comprises at least 15 contiguous nucleotides differing by 0, 1, 2, or 3 nucleotides from the sense strand of an RNAi agent to HSF1 selected from the HSF1 siRNAs disclosed herein.

Heat Shock Factor 1 (HSF1)

By "HSF1" is meant the gene or protein heat shock factor 1, or heat shock transcription factor 1 (HSTF1). HSF1 is the master regulator of the heat shock response, in which multiple genes are induced in response to temperature increase and other stresses. HSF1 has been designated HGNC ID HGNC: 5224, on Chromosome 8q24.3. It (including homologues) is also identified as: GeneID: 3297; RefSeq IDs NM_005526; AccNo. M64673; Mouse Genome Database ID MGI:96238; Rat Genome Database ID RGD:620913; Entrez Gene ID 3297; CCDS IDs CCDS6419.1; Pubmed IDs 1871105; Ensembl ID ENS G00000185122; OMIM ID (NCBI) 140580; UCSC ID (UCSC) uc003zbt.2; and/or UniProt ID (mapped data supplied by UniProt) Q00613.

The amino acid sequence of human HSF1 is provided as SEQ ID NO 2050:

(SEQ ID NO: 2050)
MDLPVGPGAAGPSNVPAFLTKLWTLVSDPDTDALICWSPSGNSFHVFDQ

GQFAKEVLPKYFKHNNMASFVRQLNMYGFRKVVHIEQGGLVKPERDDTE

FQHPCFLRGQEQLLENIKRKVTSVSTLKSEDIKIRQDSVTKLLTDVQLM

KGKQECMDSKLLAMKHENEALWREVASLRQKHAQQQKVVNKLIQFLISL

VQSNRILGVKRKIPLMLNDSGSAHSMPKYSKQFSLEHVHGSGPYSAPSP

AYSSSSLYAPDAVASSGPIISDITELAPASPMASPGGSIDERPLSSSPL

```
-continued
VRVKEEPPSPPQSPRVEEASPGRPSSVDTLLSPTALIDSILRESEPAPA

SVTALTDARGHTDTEGRPPSPPPTSTPEKCLSVACLDKNELSDHLDAMD

SNLDNLQTMLSSHGFSVDTSALLDLFSPSVTVPDMSLPDLDSSLASIQE

LLSPQEPPRPPEAENSSPDSGKQLVHYTAQPLFLLDPGSVDTGSNDLPV

LFELGEGSYFSEGDGFAEDPTISLLTGSEPPKAKDPTVS
```

The functional domains of HSF1 have been delineated by mutagenesis. A sequence near the N terminus forms the DNA binding domain (numbered approximately aa 13-121; or aa 16-120, Shi et al. Adjacent to this is a hydrophobic region comprising three "leucine zippers" that mediate monomerization and trimerization (numbered approximately aa 126-217; or 137-212; or 137-203. A fourth hydrophobic patch or leucine zipper lies at approximately aa 378-407; this region is involved in negative regulation under non-stress conditions. The central part of the molecule contains a region that regulates the activity of transcriptional activation domains in response to stress. Sequences within the regulatory domain undergo specific phosphorylation and dephosphorylation in response to stress. This regulatory domain, which is rich in serines and prolines, lies at approximately aa 221-310, or 201-370. The C-terminal portion of HSF1 contains the main transcriptional activation regions; this comprises the 100 most C-terminal amino acids, or aa 395-503, or can perhaps be reduced to AD1 at aa 401-420 (Newton et al.). These domains are described in, inter alia, Green et al. 1995 Mol. Cell. Biol. 15: 3354-3362; and Shi et al. 1995 Mol. Cell. Biol. 15: 4309-4318. The HSF1 RNAi agent of the present disclosure can interact with a specific functional domain or domains of HSF1.

In various embodiments, the RNAi agents of the present disclosure specifically bind to HSF1 mRNA, in a sequence corresponding to a functional domain, e.g., in a sequence near the N terminus that forms the DNA binding domain; in the 4/3 hydrophobic repeat or "leucine zipper" that mediates trimerization; in the first, second, third or fourth leucine zipper; in the central part of the molecule that contains several elements that maintain HSF1 in its latent form, or that regulate the activity of transcriptional activation domains in response to stress; in sequences within the regulatory domain that undergo specific phosphorylation and dephosphorylation in response to stress; in the C-terminal portion of HSF1 that contains the main transcriptional activation regions; in the arrays of amphipathic alpha-helical residues in the amino-terminal domain of HSF family proteins that interact to form coiled coils; and/or in the fourth region of amphipathic alpha-helix in the carboxyl-terminal domain. In other embodiments, the RNAi agents of the present disclosure bind to the 5' or 3' UTR [untranslated region(s)].

In various embodiments, the RNAi agents of the present disclosure bind to HSF1 mRNA, but not in a sequence corresponding to a functional domain, e.g., not in a sequence near the N terminus that forms the DNA binding domain; not the 4/3 hydrophobic repeat or "leucine zipper" that mediates trimerization; not the first, second, third or fourth leucine zipper; not the central part of the molecule that contains several elements that maintain HSF1 in its latent form, or that regulate the activity of transcriptional activation domains in response to stress; not in sequences within the regulatory domain that undergo specific phosphorylation and dephosphorylation in response to stress; not in the C-terminal portion of HSF1 that contains the main transcriptional activation regions; not in the arrays of amphipathic alpha-helical residues in the amino-terminal domain of HSF family proteins that interact to form coiled coils; not in the fourth region of amphipathic alpha-helix in the carboxyl-terminal domain; or not in the 5' or 3' UTRs. In another embodiment, the RNAi agents of the present disclosure bind to the HSF1 mRNA, but not in sequence spanning nt 322 to 340 downstream of the gene transcription start site as described by Rossi et al. 2006 Cancer Res. 66:7678-7685.

HSF1-Related Diseases

As used herein, the phrase a "HSF1-related disease" means one or more of the following: a proliferative disease, including, e.g., a cancer, wherein the cancer is selected from one or more of cancers of bladder, bone, breast, cervical, colon, colorectal, endometrial, fibrosarcoma, gastric, haematopoietic, intestine, kidney, liver, lung, lymphoma, neuroectodermal, neuroblastoma, Ewing's sarcoma, osteosarcoma, ovary, pancreas, pleura, prostate, skin, squamous cell, stomach, and testicular cancers, leukemia, promyelocytic leukemia, and Hodgkin's disease; a viral disease, wherein the viral disease is selected from one or more of viral diseases mediated in whole or in part by adenovirus, herpes simplex virus, human cytomegalovirus, HTLV-1, SV40, polyoma virus, HIV, and/or Epstein-Barr virus; and an autoimmune disease, wherein the autoimmune disease is selected from one or more of lupus and a rheumatoid arthritis.

HSF1 has been implicated in several diseases, including cancer and viral diseases. HSF1 and other heat shock proteins (whose expression is increased by HSF1) are over-expressed in, or have otherwise been implicated in bladder, bone, breast, cervical, colon, colorectal, endometrial, fibrosarcoma, gastric, haematopoietic, intestine, kidney, liver, lung, lymphoma, neuroectodermal, neuroblastoma, Ewing's sarcoma, osteosarcoma, ovary, pancreas, pleura, prostate, skin, squamous cell, stomach, and testicular cancers, leukemia (e.g., promyelocytic leukemia), and Hodgkin's disease. HSF1 is over-expressed in metastatic prostate carcinoma cell line PC-3M (as compared to the non-metastatic PC-3 line), and other prostate cancer cells.

The over-expression of HSF1 is correlated with an up-relation of heat shock protein HSP27. Hoang et al. 2000 Am. J. Pathol. 156: 857-864. HSP27 up-regulation is also associated with increased tumorigenicity and invasiveness of some cancers, including colon, breast, promyelocytic leukemia, testicular and prostate. HSF1 also plays a functional role in cancer cells under non-stress conditions; a dominant-negative HSF1 alters DNA content in PC-3 cell populations and inhibits aneuploidy. Wang et al. 2004 J. Biol. Chem. 279: 32651-32659. Many tumor types contain high concentrations of heat shock protein of the HSP27, HSP70, and HSP90 families, which are up-regulated by HSF1. Without wishing to be bound by any particular theory, applicants note that it has been suggested that heat shock proteins (HSP) may block the pathways of apoptosis and permit malignant cells to arise despite the triggering of apoptotic signals during transformation. HSP expression may also afford protection of cancer cells from treatments such as chemotherapy and hyperthermia by thwarting the pro-apoptotic influence of these modalities. Tang et al. 2005 Cell Stress Chaperones 10: 46-58 and references therein. Rossi et al. also showed that decreasing HSF1 levels increased the sensitivity of uterine cervix carcinoma cells to cisplatin associated with hyperthermia. Over-expression of heat shock proteins is also associated with protection of cancer cells against doxorubicin and hyperthermia and other anti-cancer treatments. Helmbrecht et al. 2000 Cell Prolif. 33: 341-365.

Over-expression of heat shock proteins is also associated with viral infections, including those mediated by adenovirus, herpes simplex virus, human cytomegalovirus, HTLV-1, SV40, polyoma virus, HIV, Epstein-Barr virus. High heat shock protein levels are also associated with autoimmune diseases, including lupus and rheumatoid arthritis. Inhibition of HSF1, e.g., via use of an anti-HSF1 RNAi agent, can thus be an effective treatment against cancer, and viral and other diseases. Few HSP inhibitors are known, but they include quercetin, a flavonoid that inhibits the HSF1. Zanini et al. 2007 J. Neurochem. 103:1344-354 and references therein. Quercetin can thus be used as a positive control for RNAi agents that inhibit HSF1 in treating a viral disease or cancer.

HSF1 Gene Sequences in Various Species

The human HSF1 gene has been cloned, Rabindran et al. 1991 Proc. Natl. Acad. Sci. USA 88: 6906-6910. Various sequences are available for human HSF1, including Genbank identifier NM_005526.2. The mouse (*Mus musculus*) HSF1 gene is, for example, Genbank id NM_008296.2. Another mouse HSF1 sequence is available as Acc. Number XM_128055 (as used in Yin et al. 2005 J. Mol. Cell. Card. 39: 681-689).

The Cynomolgus monkey ("Cyno", or *Macaca fascicularis*) HSF1 sequence (SEQ ID NO: 2051), compared to the human sequence (SEQ ID NO: 2052), is presented below in Table A2:

TABLE A2

```
human  GCGGCGGGAGCGCGCCCGTTGCAAGATGGCGGCGGCCATGCTGGGCCCCGGGGCTGTGTG
cyno   ---------CGCGCCCGTTGCAAGATGGCGGCGGCAAAGCTGGGCCTTGGGGCTGGGGG
                ************************** * ******   **** * * human  TGCGCAGCGGGCGGCGGCGCGGCCCGGAAGGCTGGCGCGGCGACGGCGTTAGCCCGGCCC
cyno   GGCGCAGGGGGAGGCGGNNNNNNNNNNNNNNNNNNNNNNNNNNNNNNNNNNNNNNNNNNN
       ****** *** *****

Start->
human  TCGGCCCCTCTTTGCGGCCGCTCCCTCCGCCTATTCCCTCCTTGCTCGAGATGGATCTGC
cyno   NNNNNNNNNNNNNNNNNNNNNNNNNNNNNNNNNNNNNNNNNNNNNNNNNNNCGAGATGGATCTGC
                                                           ************* human  CCGTGGGCCCCGGCGCGGCGGGGCCCAGCAAC-GTCCCGGCCTTCCTGACCAAGCTGTGG
cyno   CCGTGGGCCCCGGTGCGGCGGGGCCCAGCAANCGTCCCGGCCTTCCTGACCAAGCTGTGG
       *********** ************  ************************** human  ACCCTCGTGAGCGACCCGGACACCGACGCGCTCATCTGCTGGAGCCCGAGCGGGAACAGC
cyno   ACCCTCGTGAGCGACCCGGACACCGACGCGCTCATCTGCTGGAGCCCGAGTGGGAACAGC
       ************************************************ ******* human  TTCCACGTGTTCGACCAGGGCCAGTTTGCCAAGGAGGTGCTGCCCAAGTACTTCAAGCAC
cyno   TTCCATGTGTTCGACCAGGGCCAGTTTGCCAAGGAGGTGCTGCCCAAGTATTTCAAGCAC
       *** **************************************** ******* human  AACAACATGGCCAGCTTCGTGCGGCAGCTCAACATGTATGGCTTCCGGAAAGTGGTCCAC
cyno   AACAACATGGCCAGCTTCGTGCGGCAGCTCAACATGTATGGTTTCCGGAAAGTGGTCCAC
       *************************************** **************** human  ATCGAGCAGGGCGGCCTGGTCAAGCCAGAGAGAGACGACACGGAGTTCCACCACCCATGC
cyno   ATCGAGCAGGGTGGCCTGGTCAAGCCAGAGAGAGACGACACGGAGTTCCACCACCCGTGC
       ********* **************************************** * human  TTCCTGCGTGGCCAGGAGCAGCTCCTTGAGAACATCAA-GAGGAAAGTGACCAGTGTGTC
cyno   TTCCTGCGCGCCAGGAGCAGCTCCTTGAGAACATCANAGAGGAAAGTGACCAGTGTGTC
       ******  ********************** ****************** human  CACCCTGAAGAGTGAAGACATAAAGATCCGCCAGGACAGCGTCACCAAGCTGCTGACGGA
cyno   CACCCTGAAGAGTGAAGACATAAAGATCCGTCAGGACAGTGTCACCAAGCTGCTGACGGA
       **************************** **** ****************** human  CGTGCAGCTGATGAAGGGGAAGCAGGAGTGCATGGACTCCAAGCTCCTGGCCATGAAGCA
cyno   CGTGCAGCTGATGAAGGGGAAGCAGGAGTGCATGGACTCCAAGCTCCTGGCCATGAAGCA
       ************************************************************ human  TGAGAATGAGGCTCTGTGGCGGGAGGTGGCCAGCCTTCGGCAGAAGCATGCCCAGCAACA
cyno   TGAGAATGAGGCTCTGTGGCGGGAGGTGGCCAGCCTTCGGCAGAAGCATGCCCAGCAACA
       ************************************************************ human  GAAAGTCGTCAACAAGCTCATTCAGTTCCTGATCTCACTGGTGCAGTCAAACCGGATCCT
cyno   GAAAGTCGTCAACAAGCTCATTCAGTTCCTGATCTCACTGGTGCAGTCAAACCGGATCCT
       ************************************************************ human  GGGGGTGAAGAGAAAGATCCCCCTGATGCTGAACGACAGTGGCTCAGCACATTCCATGCC
cyno   GGGGGTGAAGAGAAAGATCCCCCTGATGCTGAACGACAGTGGCTCAGCACATTCCATGCC
       ************************************************************ human  CAAGTATAGCCGGCAGTTCTCCCTGGAGCACGTCCACGGCTCGGGCCCCTACTCGGCCCC
cyno   CAAGTATGGCCGGCAGTTCTCCCTGGAGCACGTCCACGGCTCGGGCCCCTACTCGGCCCC
       ******* ****************************************************
```

TABLE A2-continued

```
human   CTCCCCAGCCTACAGCAGCTCCAGCCTCTACGCCCCTGATGCTGTGGCCAGCTCTGGACC
cyno    CTCCCCAGCCTACAGTAGCTCCAGCCTCTACGCCCCGATTCTGTGGCCAACTCCGGACC
        ************* **************** * ****** * ***** human   CATCATCTCCGACATCACCGAGCTGGCTCCTGCCAGCCCCATGGCCTCCCCCGGCGGGAG
cyno    CATCATCTCCGACATCACCGAGCTGGCTCCTGCCAGCCCCGTGGCCTCCCCTGGCGGGAG
        ************************************** ****** ***** human   CATAGACGAGAGGCCCCTATCCAGCAGCCCCTGGTGCGTGTCAAGGAGGAGCCCCCCAG
cyno    CATAGACGAGAGGCCCCTGTCTAGCAGCCCCTGGTGCGTGTCAAAGAGGAGCCCCCCAG
        ****************  ******************** ************ human   CCCGCCTCAGAGCCCCCGGGTAGAGGAGGCGAGTCCCGGGCGCCCATCTTCCGTGGACAC
cyno    CCCGCCTCAGAGCCCCGGGTAGAGGAGGCGAGTCCCGGGCGCCCATCTTCCGTGGACAC
        ************** ***************************************** human   CCTCTTGTCCCCGACCGCCCTCATTGACTCCATCCTGCGGGAGAGTGAACCTGCCCCCGC
cyno    CCTCTTGTCCCCGACCGCCCTCATTGACTCCATCCTGCGGGAGAGTGAACCTACCCCCGC
        ************************************************** ***** human   CTCCGTCACAGCCCTCACGGACGCCAGGGGCCACACGGACACCGAGGGCCGGCCTCCCTC
cyno    CTCCGCCACAGCCCTCACCGATGCCAGGGGCCACACGGACACCGAGGGCCGGCCTCCCTC
        *** ********  ************************************** human   CCCCCCGCCCACCTCCACCCCTGAAAAGTGCCTCAGCGTAGCCTGCCTGGACAAGAATGA
cyno    ACCCCCGCCCACCTCCACCCCTGAAAAGTGCCTCAGCGTAGCCTGCCTGGACAAGAATGA
         *********************************************************** human   GCTCAGTGACCACTTGGATGCTATGGACTCCAACCTGGATAACCTGCAGACCATGCTGAG
cyno    GCTCAGTGATCACTTGGATGCTATGGACTCCAACCTGGACAACCTGCAGACCATGCTGAG
        ******* ************************ ******************* human   CAGCCACGGCTTCAGCGTGGACACCAGTGCCCTGCTGGACCTGTTCAGCCCCTCGGTGAC
cyno    CAGCCACCGCTTCAGCGTGGACACCAGCGCCCTGCTGGACCTGTTCAGCCCCTCGGTGAC
        ***** *************** ****************************** human   CGTGCCCGACATGAGCCTGCCTGACCTTGACAGCAGCCTGGCCAGTATCCAAGAGCTCCT
cyno    CGTGCCCGACATGAGCCTGCCTGACCTTGACAGCAGCCTGGCTAGTATCCAAGAGCTCCT
        **************************************** *************** human   GTCTCCCCAGGAGCCCCCCAGGCCTCCCGAGGCAGAGAACAGCAGCCCGGATTCAGGGAA
cyno    GTCTCCCCAGGAGCCCTCCAGGCCTCCCGAGGCAGAGAACACCAGCCCGGATTCAGGGAA
        ************** ******************** **************** human   GCAGCTGGTGCACTACACAGCGCAGCCGCTGTTCCTGCTGGACCCCGGCTCCGTGGACAC
cyno    GCAGCTGGTGCACTACACAGCACAGCCACTGTTCCTGCTCGACCCCGGCTCCGTGGGCAC
        ******************* * ******* ************ * human   CGGGAGCAACGACCTGCCGGTGCTGTTTGAGCTGGGAGAGGGCTCCTACTTCTCCGAAGG
cyno    CGGGAGCAGCGACTTGCCGGTGCTGTTTGAGCTGGGGGAGGGCTCCTACTTCTCCGAAGG
        ******  ****************** ********************* human   GGACGGCTTCGCCGAGGACCCCACCATCTCCCTGCTGACAGGCTCGGAGCCTCCCAAAGC
cyno    GGACGGCTTCGCAGAGGACCCCACCATCTCCCTGCTGACAGGCTCAGAGCCTCCCAAAGC
        ************ ******************************** **************

STOP
human   CAAGGACCCCACTGTCTCCTAGAGGCCCCGGAGGAGCTGGGCCAGCCGCCCACCCCCACC
cyno    CAAGGACCCCACTGTCTCCTAGCGCCCCGGAGGAGCTGGGCCAGCCGCCCACCCCCACC
        *****************     ****************************** human   CCCAGTGCAGGGCTGGTCTTGGGGAGGCAG-GGCAGCCTCGCGGTCTTGGGCACTGGTGG
cyno    CCCAGTGCAGGGCTGGCCTTGGGGAGGAAGAGGCAGCCTCGAGGTCCTGGGCACTGGTGG
        ************** ******  ********  *********** human   GTCGGCCGCCATAGCCCCAGTAGGACAAAC--GGGCTCGGGTCTGGGCAGCACCTCTGGT
cyno    GTTGGCCACCACAGCCCCAGTAGGACAAACAGGGGCTCAGGTCTGGGCAGCACCTCTGGT
          * **************** ** ******************** human   CAGGAGGGTCACCCTGGCCTGCCAGTCTGCCTTCCCCCAACCCCGTGTCCTGTGGTTTGG
cyno    CAGGAGGGTCACCCCGGCCTCCCAGTCTGCCTTCCCCCAACCCCGTGTCCTGTGGTTTGG
        ************ * ************************************* human   TTGGGGCTTCACAGCCACACCTGGACTGACCCTGCAGGTTGTTCATAGTCAGAATTGTAT
cyno    TTGGGGCTTCGTAGCCACACCTGGACTGACCCTGCAGGTTGTTCATAATCAGAATTGTAT
        ********  ****************************** *********** human   TTTGGATTTTTACACAACTGTCCCGTTCCCCGCTCCACAGAGATACACAGATATATACAC
cyno    TTTGGATTTTTACACAACTGTCCCATTCCCTGTTCCATAGAGATATACAGATATATACAC
        ************************  ****  * **** ****** **************
```

TABLE A2-continued

```
human  ACAG-TGGATGGACGGACAAGACAGGCAGAGATCTATAAACAGACAGGCTCTATGCTAAA
cyno   ACAGGTGGATGGACGGACAAGACAGGCAGAGATCTATAAACAGACAG-------------
       ** ***************************************** human  AAAAAAAAAAAA  (SEQ ID NO: 2051)
cyno   ------------  (SEQ ID NO: 2052)
```

The start (ATG) and stop (TAG) of the human HSF1 sequence and putative start and stop of the cyno HSF1 sequence are indicated in bold underlined. N indicates that the nucleotide was not determined at that position in the sequencing experiment.

In one embodiment, the HSF1 RNAi agent of the present disclosure comprises a sequence which is identical in the human, mouse and cyno HSF1 gene. This sequence identity facilitates animal testing prior to human testing.

In one embodiment, the HSF1 RNAi agent comprises a sequence which does not match that of any other gene. In one embodiment, the HSF1 RNAi agent comprises a sequence which differs from all other known non-HSF1 genes by at least 0, 1, 2 or 3 nucleotides.

In one embodiment, the HSF1 RNAi agent comprises a sequence which is identical to that in HSF2, HSF3 or HSF4. In one embodiment, the HSF1 RNAi agent comprises a sequence which is not identical to any in HSF2, HSF3 or HSF4.

HSF1 RNAi Agent for Use in Treating Various HSF1-Related Diseases

In one embodiment, the HSF1 RNAi agent of the present disclosure comprises a sequence disclosed herein and is administered to a patient in need thereof (e.g., a patient suffering from cancer and/or a viral disease and/or autoimmune disease and/or HSF1-related disease). In one embodiment, the HSF1 RNAi agent of the present disclosure is administered to a patient in need thereof, along with one or more additional pharmaceutical agent appropriate for that disease. For example, a patient suffering from cancer can be administered a pharmacologically effective amount of one or more HSF1 RNAi agent along with a pharmacologically effective amount of one or more of any cancer treatment listed herein, and/or any other cancer treatment known in the art.

A patient suffering from a viral disease can be administered one or more RNAi agent to HSF1 and one or more additional viral disease treatment. This additional treatment can be selected from the list of any viral disease treatment listed herein, and/or any anti-viral known in the art.

The patient can also be administered more than one RNAi agent to HSF1.

In the case of cancer, autoimmune and viral diseases, the RNAi agent(s) and additional disease treatment(s) can be administered in any order, simultaneously or sequentially, or in multiple doses over time. Administration of the RNAi agent and the additional treatment can be, for example, simultaneous, concurrent, separate or sequential.

Simultaneous administration may, e.g., take place in the form of one fixed combination with two or more active ingredients, or by simultaneously administering two or more active ingredients that are formulated independently. Sequential use (administration) preferably means administration of one (or more) components of a combination at one time point, other components at a different time point, that is, in a chronically staggered manner, preferably such that the combination shows more efficiency than the single compounds administered independently (especially showing synergism). Separate use (administration) preferably means administration of the components of the combination independently of each other at different time points, preferably meaning that the components (a) and (b) are administered such that no overlap of measurable blood levels of both compounds are present in an overlapping manner (at the same time).

Also combinations of two or more of sequential, separate and simultaneous administration are possible, preferably such that the combination component-drugs show a joint therapeutic effect that exceeds the effect found when the combination component-drugs are used independently at time intervals so large that no mutual effect on their therapeutic efficiency can be found, a synergistic effect being especially preferred.

The term "delay of progression" as used herein means administration of the combination to patients being in a pre-stage or in an early phase, of the first manifestation or a relapse of the disease to be treated, in which patients, e.g., a pre-form of the corresponding disease is diagnosed or which patients are in a condition, e.g., during a medical treatment or a condition resulting from an accident, under which it is likely that a corresponding disease will develop.

"Jointly therapeutically active" or "joint therapeutic effect" means that the compounds may be given separately (in a chronically staggered manner, especially a sequence-specific manner) in such time intervals that they preferably, in the warm-blooded animal, especially human, to be treated, still show a (preferably synergistic) interaction (joint therapeutic effect). Whether this is the case, can inter alia be determined by following the blood levels, showing that both compounds are present in the blood of the human to be treated at least during certain time intervals.

DEFINITIONS

For convenience, the meaning of certain terms and phrases used in the specification, examples, and appended claims, are provided below. If there is an apparent discrepancy between the usage of a term in other parts of this specification and its definition provided in this section, the definition in this section shall prevail.

As used throughout this disclosure, articles such as "a" and "an" refer to one or more than one (at least one) of the grammatical object of the article.

RNAi Agent

As used herein, the term "RNAi agent," "RNAi agent to HSF1", "siRNA to HSF1", "HSF1 siRNA" and the like refer to an siRNA (short inhibitory RNA), shRNA (short or small hairpin RNA), iRNA (interference RNA) agent, RNAi (RNA interference) agent, dsRNA (double-stranded RNA), microRNA, and the like, which specifically binds to the HSF1 gene. As used herein, the terms "iRNA" and "RNAi" refers to an agent that contains RNA, and which mediates the targeted cleavage of another RNA transcript via an RNA-induced silencing complex (RISC) pathway. In one embodiment, the RNAi agent is an oligonucleotide composition that activates the RISC complex/pathway. In another embodiment, the RNAi agent comprises an antisense strand sequence (antisense oligonucleotide). In one embodiment, the RNAi comprises a single strand. This single-stranded RNAi agent oligonucleotide or polynucleotide can comprise the sense or antisense strand, as described by Sioud 2005 J. Mol. Biol. 348:1079-1090, and references therein. Thus the disclosure encompasses RNAi agents with a single strand comprising either the sense or antisense strand of an RNAi agent described herein.

RNA interference is a post-transcriptional, targeted gene-silencing technique that uses double-stranded RNA (dsRNA) to degrade messenger RNA (mRNA) containing the same sequence as the dsRNA. The process of RNAi occurs when ribonuclease III (Dicer) cleaves the longer dsRNA into shorter fragments called siRNAs. siRNAs (small interfering RNAs) are typically about 21 to 23 nucleotides long and comprise about 19 base pair duplexes. The smaller RNA segments then mediate the degradation of the target mRNA. Dicer has also been implicated in the excision of 21- and 22-nucleotide small temporal RNAs (stRNAs) from precursor RNA of conserved structure that are implicated in translational control. Hutvagner et al. 2001, Science, 293, 834. The RNAi response also features an endonuclease complex, commonly referred to as an RNA-induced silencing complex (RISC), which mediates cleavage of single-stranded mRNA complementary to the antisense strand of the siRNA. Cleavage of the target RNA takes place in the middle of the region complementary to the antisense strand of the siRNA duplex.

Kits for RNAi synthesis are commercially available, e.g., from New England Biolabs and Ambion.

The use of the RNAi agent to HSF1 results in a decrease of HSF1 activity, level and/or expression, e.g., a "knock-down" or "knock-out" of the target gene or target sequence.

A suitable RNAi agent can be selected by any process known in the art or conceivable by one of ordinary skill in the art. For example, the selection criteria can include one or more of the following steps: initial analysis of the HSF1 gene sequence and design of RNAi agents; this design can take into consideration sequence similarity across species (human, cynomolgus, mouse, etc.) and dissimilarity to other (non-HSF1) genes; screening of RNAi agents in vitro (e.g., at 10 nM in WI-38 cells); determination of EC50 in HeLa cells; determination of viability of WI-38, HeLa and GTL16 cells treated with RNAi agents, wherein it is desired that the RNAi agent to HSF1 not inhibit the viability of these cells; testing with human PBMC (peripheral blood mononuclear cells), e.g., to test levels of TNF-alpha to estimate immunogenicity, wherein immunostimulatory sequences are less desired; testing in human whole blood assay, wherein fresh human blood is treated with an RNAi agent and cytokine/chemokine levels are determined [e.g., TNF-alpha (tumor necrosis factor-alpha) and/or MCP1 (monocyte chemotactic protein 1)], wherein Immunostimulatory sequences are less desired; determination of gene knockdown in vivo using Hep3B subcutaneous tumors in test animals; HSF1 target gene modulation analysis, e.g., using a pharmacodynamic (PD) marker, for example, HSP70 or HSP27, wherein HSF1 knockdown leads to a dose-dependent reduction of HSP70 and HSP27 expression in A375 cells; and optimization of specific modifications of the RNAi agents.

Targets and Sequences

As used herein, "target sequence" or "target gene" refer to a contiguous portion of the nucleotide sequence of an mRNA molecule formed during the transcription of a gene, e.g., a HSF1 gene, including mRNA that is a product of RNA processing of a primary transcription product. The target portion of the sequence will be at least long enough to serve as a substrate for iRNA-directed cleavage at or near that portion. For example, the target sequence will generally be from about 9-36 nucleotides ("nt") in length, e.g., about 15-30 nucleotides in length, including all sub-ranges therebetween. As non-limiting examples, the target sequence can be from about 15-30 nt, about 15-26 nt, about 15-23 nt, about 15-22 nt, about 15-21 nt, about 15-20 nt, about 15-19 nt, about 15-18 nt, about 15-17 nt, about 18-30 nt, about 18-26 nt, about 18-23 nt, about 18-22 nt, about 18-21 nt, about 18-20 nt, about 19-30 nt, about 19-26 nt, about 19-23 nt, about 19-22 nt, about 19-21 nt, about 19-20 nt, about 20-30 nt, about 20-26 nt, about 20-25 nt, about 20-24 nt, about 20-23 nt, about 20-22 nt, about 20-21 nt, about 21-30 nt, about 21-26 nt, about 21-25 nt, about 21-24 nt, about 21-23 nt, or about 21-22 nt.

As used herein, the term "strand comprising a sequence" refers to an oligonucleotide comprising a chain of nucleotides that is described by the sequence referred to using the standard nucleotide nomenclature.

As used herein, and unless otherwise indicated, the term "complementary" refers to the ability of an oligonucleotide or polynucleotide comprising a first nucleotide sequence to hybridize and form a duplex structure under certain conditions with an oligonucleotide or polynucleotide comprising a second nucleotide sequence. Such conditions can, for example, be stringent, e.g., 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both sequences. Such sequences can be referred to as "fully complementary" with respect to each other herein. However, where a first sequence is referred to herein as "substantially complementary" with respect to a second sequence, the two sequences can be fully complementary, or they may form one or more, but generally not more than 5, 4, 3 or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nt in length and another oligonucleotide 23 nt in length, wherein the longer oligonucleotide comprises a sequence of 21 nt that is fully complementary to the shorter oligonucleotide, may yet be referred to as "fully complementary" for the purposes herein.

"Complementary" sequences, as used herein, may also include, or be formed entirely from, non-Watson-Crick base pairs and/or base pairs formed from non-natural and modified nucleotides, in as far as the above requirements with respect to their ability to hybridize are fulfilled. Such non-Watson-Crick base pairs includes, but are not limited to, G:U Wobble or Hoogstein base pairing.

The terms "complementary," "fully complementary" and "substantially complementary" herein may be used with respect to the base matching between the sense strand and the antisense strand of a dsRNA, or between the antisense strand of an iRNA agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding HSF1). For example, a polynucleotide is complementary to at least a part of a HSF1 mRNA if the sequence is substantially complementary to a non-interrupted portion of an mRNA encoding HSF1.

Double-Stranded RNA

The term "double-stranded RNA" or "dsRNA," as used herein, refers to an iRNA that includes an RNA molecule or complex of molecules having a hybridized duplex region that comprises two anti-parallel and substantially complementary nucleic acid strands, which will be referred to as having "sense" and "antisense" orientations with respect to a target RNA. The antisense strand, with respect to the mRNA target, is also called the "guide" strand, and the sense strand is also called the "passenger" strand. The passenger strand can include at least one or more of the following: one or more extra nucleotides (e.g., a bulge or 1 nt loop) compared to the other strand, a nick, a gap, etc., compared to the other strand.

The duplex region can be of any length that permits specific degradation of a desired target RNA through a RISC pathway, but will typically range from 9 to 36 base pairs in length, e.g., 15-30 base pairs in length. Considering a duplex between 9 and 36 base pairs, the duplex can be any length in this range, for example, 9, 10, 11, 12, 13, 14, 15, 16, 17, 18, 19, 20, 21, 22, 23, 24, 25, 26, 27, 28, 29, 30, 31, 32, 33, 34, 35, or 36 and any sub-range therebetween, including, but not limited to 15-30 base pairs ("bp"), 15-26 bp, 15-23 bp, 15-22 bp, 15-21 bp, 15-20 bp, 15-19 bp, 15-18 bp, 15-17 bp, 18-30 bp, 18-26 bp, 18-23 bp, 18-22 bp, 18-21 bp, 18-20 bp, 19-30 bp, 19-26 bp, 19-23 bp, 19-22 bp, 19-21 bp, 19-20 bp, 20-30 bp, 20-26 bp, 20-25 bp, 20-24 bp, 20-23 bp, 20-22 bp, 20-21 bp, 21-30 bp, 21-26 bp, 21-25 bp, 21-24 bp, 21-23 bp, or 21-22 bp. dsRNAs generated in the cell by processing with Dicer and similar enzymes are generally in the range of about 19-22 base pairs in length. One strand of the duplex region of a dsDNA comprises a sequence that is substantially complementary to a region of a target RNA. The two strands forming the duplex structure can be from a single RNA molecule having at least one self-complementary region, or can be formed from two or more separate RNA molecules. Where the duplex region is formed from two strands of a single molecule, the molecule can have a duplex region separated by a single stranded chain of nucleotides (herein referred to as a "hairpin loop") between the 3'-end of one strand and the 5'-end of the respective other strand forming the duplex structure. The hairpin loop can comprise at least one unpaired nucleotide; in some embodiments the hairpin loop can comprise at least 3, at least 4, at least 5, at least 6, at least 7, at least 8, at least 9, at least 10, at least 20, at least 23 or more unpaired nucleotides. Where the two substantially complementary strands of a dsRNA are comprised by separate RNA molecules, those molecules need not, but can be covalently connected. Where the two strands are connected covalently by means other than a hairpin loop, the connecting structure is referred to as a "linker." The term "siRNA" is also used herein to refer to a dsRNA as described above.

In one aspect, an RNA interference agent includes a single stranded RNA that interacts with a target RNA sequence to direct the cleavage of the target RNA. Without wishing to be bound by theory, long double stranded RNA introduced into plants and invertebrate cells is broken down into siRNA by a Type III endonuclease known as Dicer (Sharp et al., Genes Dev. 2001, 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleaves the target to induce silencing (Elbashir, et al., (2001) Genes Dev. 15:188). Thus, in one aspect the disclosure relates to a single stranded RNA that promotes the formation of a RISC complex to effect silencing of the target gene.

Down-Regulation of HSF1

As used herein, "down-regulates" refers to any statistically significant decrease in a biological activity and/or expression of HSF1, including full blocking of the activity (i.e., complete inhibition) and/or expression. For example, "down-regulation" can refer to a decrease of at least about 10, 20, 30, 40, 50, 60, 70, 80, 90 or 100% in HSF1 activity and/or expression.

As used herein, the term "inhibit" or "inhibiting" HSF1 refers to any statistically significant decrease in biological activity and/or expression of HSF1, including full blocking of the activity and/or expression. For example, "inhibition" can refer to a decrease of at least about 10, 20, 30, 40, 50, 60, 70, 80, 90 or 100% in HSF1 activity and/or expression. As used herein, the term "inhibit" similarly refers to a significant decrease in activity and/or expression, while referring to any other biological agent or composition.

By "level", it is meant that the HSF1 RNAi agent can interfere with the detectable level of HSF1, e.g., the level of HSF1 mRNA or the level of HSF1 protein.

By "activity," it is meant that the HSF1 RNAi agent can alter any known activity of HSF1, as described herein or as known in the literature.

By "heat shock" (HS) and "heat shock response" (HSR) is meant the biochemical response to environmental stress, such as elevated temperature. In the laboratory, experimental animals and cells can be maintained at a "non-shock" temperature (37° C. or lower) and heat shock can be induced at an elevated temperature (e.g., 40, 41, 42, 43, 44, or 45 degrees C. or higher). Experimentally, heat shock is typically induced at 42, 43 or 44 degrees C.

Heat shock is characterized by misfolding, denaturation and aggregation of various proteins; the induced heat shock proteins (HSP or HSPs) include chaperone proteins (chaperonins) and others which repair and/or remove these proteins. Genes induced during the heat shock response include, inter alia, HSP90, HSP70 and HSP27. The heat shock response can also be induced (or mimicked) by additional environmental conditions, such as oxidative stress, chemical stress, free radicals, ATP depletion, acidosis, heavy metals, alcohols, presence of antibiotics, inhibitors of energy metabolism, pathological conditions such as ischemia and reperfusion, inflammation, tissue damage, infection and mutant proteins associated with genetic diseases. Jolly et al. 2000 J. Natl. Cancer Inst. 92: 1564-1572; Dai et al. 2007 Cell 130: 1005-1018.

The RNAi Agent to HSF1

In one embodiment, the disclosure pertains to a HSF1 RNAi agent or other antisense nucleic acid complementary to a HSF1 gene (or portion thereof), or a recombinant expression vector encoding the antisense nucleic acid. As used herein, an "antisense" nucleic acid comprises a nucleotide sequence complementary to a "sense" nucleic acid encoding the HSF1 protein (e.g., complementary to the coding strand of a double-stranded DNA, complementary to an mRNA or complementary to the coding strand of a HSF1 gene).

The use of antisense nucleic acids to down-modulate the expression of a particular protein in a cell is well known in the art. An antisense nucleic acid comprises a sequence complementary to, and is capable of hydrogen binding to, the coding strand of another nucleic acid (e.g., an mRNA). Antisense sequences complementary to an mRNA can be complementary to the coding region, the 5' or 3' untranslated region of the mRNA, and/or a region bridging the coding and untranslated regions, and/or portions thereof. Furthermore, an antisense nucleic acid can be complementary to a regulatory region of the gene encoding the mRNA, for instance a transcription or translation initiation sequence or regulatory element. Preferably, an antisense nucleic acid can be complementary to a region preceding or spanning the initiation codon on the coding strand or in the 3' untranslated region of an mRNA.

Antisense nucleic acids can be designed according to the rules of Watson and Crick base pairing. The antisense nucleic acid molecule can be complementary to the entire coding region of HSF1 mRNA, but in at least one embodiment is an oligonucleotide which is antisense to only a portion of the coding or non-coding region of HSF1 mRNA. For example, the antisense oligonucleotide can be complementary to the region surrounding the translation start site of HSF1 mRNA. An antisense oligonucleotide can be, for example, about 5, about 10, about 15, about 16, about 17, about 18, about 19, about 20, about 21, about 22, about 23, about 24, about 25, about 30, about 35, about 40, about 45 or about 50 nt in length, or 5, 10, 15, 16, 17, 18, 19, 20, 21, 22, 23, 24, 25, 30, 35, 40, 45 or 50 nt in length.

siRNA may have modifications internally, or at one or both ends. Example modifications at the 5' end are illustrated in FIG. 1. These include: C6-alkyl (5'-hexylphosphate), 5'-Methyoxy; 5'-inverted dT (idT), and 5'-beta-L-uridine. The modifications at the ends can help stabilize the siRNA, protecting it from degradation by nucleases in the blood. The siRNAs may optionally be directed to regions of the HSF1 mRNA known or predicted to be near or at splice sites of the gene; e.g., exon-intron junctions. The siRNAs can also optionally be designed to anneal to known or predicted exposed and/or single-stranded regions of the mRNA (e.g., loops).

An antisense nucleic acid can be constructed using chemical synthesis and enzymatic ligation reactions using procedures known in the art. For example, an antisense nucleic acid (e.g., an antisense oligonucleotide) can be chemically synthesized using naturally-occurring nucleotides or variously modified nucleotides designed to decrease off-target effects, and/or increase the biological stability of the molecules or to increase the physical stability of the duplex formed between the antisense and sense nucleic acids. In at least one embodiment a modified sugar backbone, including a phosphorothioate linkage or its derivatives, and acridine substituted nucleotides can be used.

Each of "G," "C," "A," "T" and "U" generally stand for a nucleotide that contains guanine, cytosine, adenine, thymidine and uracil as a base, respectively. However, the term "ribonucleotide" or "nucleotide" can also refer to a modified nucleotide or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in the nucleotide sequences of dsRNA featured in the disclosure by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the disclosure.

Modifications

The skilled artisan will recognize that the term "RNA molecule" or "ribonucleic acid molecule" encompasses not only RNA molecules as expressed or found in nature, but also analogs and derivatives of RNA comprising one or more ribonucleotide/ribonucleoside analogs or derivatives as described herein or as known in the art. Strictly speaking, a "ribonucleoside" includes a nucleoside base and a ribose sugar, and a "ribonucleotide" is a ribonucleoside with one, two or three phosphate moieties. However, the terms "ribonucleoside" and "ribonucleotide" can be considered to be equivalent as used herein. The RNA can be modified in the nucleobase structure or in the ribose-phosphate backbone structure, e.g., as described herein below. However, the molecules comprising ribonucleoside analogs or derivatives must retain the ability to form a duplex. As non-limiting examples, an RNA molecule can also include at least one modified ribonucleoside, including but not limited to a 2'-O-methyl modified nucleotide, a nucleoside comprising a 5' phosphorothioate linkage group, a terminal nucleoside linked to a cholesteryl derivative or dodecanoic acid bisdecylamide group, a locked nucleoside, an abasic nucleoside, a 2'-deoxy-2'-fluoro modified nucleoside, a 2'-amino-modified nucleoside, 2'-alkyl-modified nucleoside, morpholino nucleoside, an unlocked ribonucleotide (e.g., an acyclic nucleotide monomer, as described in WO 2008/147824), a phosphoramidate or a non-natural base comprising nucleoside, or any combination thereof. Alternatively, an RNA molecule can comprise at least two modified ribonucleosides, at least 3, at least 4, at least 5, at least 6, at least 7, at least 8, at least 9, at least 10, at least 15, at least 20 or more, up to the entire length of the dsRNA molecule. The modifications need not be the same for each of such a plurality of modified ribonucleosides in an RNA molecule. In one embodiment, modified RNAs contemplated for use in methods and compositions described herein are peptide nucleic acids (PNAs) that have the ability to form the required duplex structure and that permit or mediate the specific degradation of a target RNA via a RISC pathway.

Examples of modified nucleotides which can be used to generate the antisense nucleic acid include 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl)uracil, (acp3)w, and 2,6-diaminopurine.

In one aspect, a modified ribonucleoside includes a deoxyribonucleoside. In such an instance, an iRNA agent can comprise one or more deoxynucleosides, including, for example, a deoxynucleoside overhang(s), or one or more deoxynucleosides within the double stranded portion of a dsRNA. However, it is self-evident that under no circumstances is a double stranded DNA molecule encompassed by the term "iRNA."

Replacing the 3'-terminal nucleotide overhanging segments of a 21-mer siRNA duplex having two-nucleotide 3'-overhangs with deoxyribonucleotides does not have an adverse effect on RNAi activity. Replacing up to four nucleotides on each end of the siRNA with deoxyribonucleotides has been well tolerated, whereas complete substitution with deoxyribonucleotides results in no RNAi activity. International PCT Publication No. WO 00/44914, and Beach et al. International PCT Publication No. WO 01/68836 preliminarily suggest that siRNA may include modifications to either the phosphate-sugar backbone or the nucleoside to include at least one of a nitrogen or sulfur heteroatom. Kreutzer et al. Canadian Patent Application No. 2,359,180, also describe certain chemical modifications for use in dsRNA constructs in order to counteract activation of double-stranded RNA-dependent protein kinase PKR, specifically 2"-amino or 2'-O-methyl nucleotides, and nucleotides containing a 2"-0 or 4"-C methylene bridge. Additional 3'-terminal nucleotide overhangs include dT (deoxythimidine), 2'-O,4'-C-ethylene thymidine (eT), and 2-hydroxyethyl phosphate (hp).

Parrish et al. (2000 Molecular Cell 6: 1077-1087) tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that RNAs with two phosphorothioate modified bases also had substantial decreases in effectiveness as RNAi. Further, Parrish et al. reported that phosphorothioate modification of more than two residues greatly destabilized the RNAs in vitro such that interference activities could not be assayed. Id. at 1081. The authors also tested certain modifications at the 2'-position of the nucleotide sugar in the long siRNA transcripts and found that substituting deoxynucleotides for ribonucleotides produced a substantial decrease in interference activity, especially in the case of Uridine to Thymidine and/or Cytidine to deoxy-Cytidine substitutions. Id. In addition, the authors tested certain base modifications, including substituting, in sense and antisense strands of the siRNA, 4-thiouracil, 5-bromouracil, 5-iodouracil, and 3-(aminoallyl)uracil for uracil, and inosine for guanosine. Whereas 4-thiouracil and 5-bromouracil substitution appeared to be tolerated, Parrish reported that inosine produced a substantial decrease in interference activity when incorporated in either strand. Parrish also reported that incorporation of 5-iodouracil and 3-(aminoallyl)uracil in the antisense strand resulted in a substantial decrease in RNAi activity as well.

Those skilled in the art will appreciate that it is possible to synthesize and modify the siRNA as desired, using any conventional method known in the art (see Henschel et al. 2004 DEQOR: a web-based tool for the design and quality control of siRNAs. Nucleic Acids Research 32 (Web Server Issue): W113-W120). Further, it will be apparent to those skilled in the art that there are a variety of regulatory sequences (for example, constitutive or inducible promoters, tissue-specific promoters or functional fragments thereof, etc.) which are useful for the antisense oligonucleotide, siRNA, or shRNA expression construct/vector.

There are several examples in the art describing sugar, base, phosphate and backbone modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren 1992 TIBS. 17: 34; Usman et al. 1994 Nucleic Acids Symp. Ser. 31: 163; Burgin et al. 1996 Biochemistry 35: 14090). Sugar modifications of nucleic acids have been extensively described in the art.

Additional modifications and conjugations of RNAi agents have been described. Soutschek et al. 2004 Nature 432: 173-178 presented conjugation of cholesterol to the 3'-end of the sense strand of a siRNA molecule by means of a pyrrolidine linker, thereby generating a covalent and irreversible conjugate. Chemical modifications (including conjugation with other molecules) of siRNA may also be made to improve the in vivo pharmacokinetic retention time and efficiency.

In various embodiments, the RNAi agent to HSF1 comprises at least one 5'-uridine-adenine-3' (5'-ua-3') dinucleotide, wherein the uridine is a 2'-modified nucleotide; at least one 5'-uridine-guanine-3' (5'-ug-3') dinucleotide, wherein the 5'-uridine is a 2'-modified nucleotide; at least one 5'-cytidine-adenine-3' (5'-ca-3') dinucleotide, wherein the 5'-cytidine is a 2'-modified nucleotide; or at least one 5'-uridine-uridine-3' (5'-uu-3') dinucleotide, wherein the 5'-uridine is a 2'-modified nucleotide.

In various embodiments, the RNAi agent comprises a 2"-modification selected from the group consisting of: 2'-deoxy, 2'-deoxy-2'-fluoro, 2'-O-methyl, 2"-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2"-O—N-methylacetamido (2'-O—NMA).

In another embodiment, the RNAi comprises a gap or missing base. For example, the phosphate-sugar backbone may be present, but the base missing.

In another embodiment, the RNAi agent has a single-stranded nick (e.g., a break or missing bond in the backbone). This nick can be, for example, in the sense strand, producing a small internally segmented interfering RNA, or sisiRNA, which may have less off-target effects than the corresponding RNAi agent without a nick.

The antisense nucleic acid or RNAi agent can also have an alternative backbone such as locked nucleic acids (LNA), Morpholinos, peptidic nucleic acids (PNA), threose nucleic acid (TNA), or glycol nucleic acid (GNA), and/or it can be labeled (e.g., radiolabeled or otherwise tagged). One or both strands can comprise an alternative backbone.

In yet another embodiment, the antisense nucleic acid molecule employed by the methods of the present disclosure can include an α-anomeric nucleic acid molecule. An α-anomeric nucleic acid molecule forms specific double-stranded hybrids with complementary RNA in which, contrary to the usual β-units, the strands run parallel to each other. Gaultier et al. 1987 Nucleic Acids. Res. 15: 6625-6641. The antisense nucleic acid molecule can also comprise a 2'-o-methylribonucleotide (Inoue et al. 1987 Nucleic Acids Res. 15: 6131-6148) or a chimeric RNA-DNA analogue (Inoue et al. 1987 FEBS Lett. 215: 327-330).

In still another embodiment, an antisense nucleic acid is a ribozyme. Ribozymes are catalytic RNA molecules with ribonuclease activity which are capable of cleaving a single-stranded nucleic acid, such as an mRNA, to which they have a complementary region. Thus, ribozymes [e.g., hammerhead ribozymes (described in Haselhoff et al. 1988, Nature 334: 585-591)] can be used to catalytically cleave HSF1 mRNA transcripts to thereby inhibit translation of HSF1 mRNA.

Alternatively, gene expression can be inhibited by targeting nucleotide sequences complementary to the regulatory region of HSF1 (e.g., the promoter and/or enhancers) to form triple helical structures that prevent transcription of the HSF1 gene. See generally, Helene 1991 Anticancer Drug Des. 6(6): 569-84; Helene et al. 1992 Ann. N.Y. Acad. Sci. 660: 27-36; and Maher 1992, Bioassays 14(12): 807-15.

Alternatively, the antisense nucleic acid can be produced biologically using an expression vector into which a nucleic acid has been subcloned in an antisense orientation (i.e., RNA transcribed from the inserted nucleic acid will be in an antisense orientation to a target nucleic acid of interest).

The antisense nucleic acid molecules of the present disclosure are typically administered to a subject or generated in situ such that they hybridize with cellular mRNA and/or genomic DNA encoding HSF1, and inhibit expression by inhibiting transcription and/or translation. An example of a route of administration of antisense nucleic acid molecules includes direct injection at a tissue site. Alternatively, antisense nucleic acid molecules can be modified to target selected cells and then administered systemically. For example, for systemic administration, antisense molecules can be modified such that they specifically bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using vectors well known in the art and described in, for example, US20070111230, the entire contents of which are incorporated herein. To achieve sufficient intracellular concentrations of the antisense molecules, vector constructs in which the antisense nucleic acid molecule is placed under the control of a strong pol II or pol III promoter can be used.

RNA Interference

RNAi (RNA interference) has been studied in a variety of systems. Recent work in Drosophila embryonic lysates (Elbashir et al. 2001 EMBO J. 20: 6877 and Tuschl et al. International PCT Publication No. WO 01/75164) has revealed certain requirements for siRNA length, structure, chemical composition, and sequence that are essential to mediate efficient RNAi activity. These studies have shown that 21-nucleotide siRNA duplexes are most active when containing 3'-terminal dinucleotide overhangs. Substitution of the 3'-terminal siRNA overhang nucleotides with 2'-deoxy nucleotides (2'-H) was tolerated. In addition, a 5'-phosphate on the target-complementary strand of an siRNA duplex is usually required for siRNA activity.

The use of longer dsRNA has been described. For example, Beach et al. International PCT Publication No. WO 01/68836, describes attenuating gene expression using endogenously-derived dsRNA. Tuschl et al. International PCT Publication No. WO 01/75164, describe a Drosophila in vitro RNAi system and the use of specific siRNA molecules for certain functional genomic and certain therapeutic applications. Li et al. International PCT Publication No. WO 00/44914, describe the use of specific long (141 bp-488 bp) enzymatically synthesized or vector expressed dsRNAs for attenuating the expression of certain target genes. Zernicka-Goetz et al. International PCT Publication No. WO 01/36646, describe certain methods for inhibiting the expression of particular genes in mammalian cells using certain long (550 bp-714 bp), enzymatically synthesized or vector expressed dsRNA molecules. Fire et al. International PCT Publication No. WO 99/32619, describe particular methods for introducing certain long dsRNA molecules into cells for use in inhibiting gene expression in nematodes. Plaetinck et al. International PCT Publication No. WO 00/01846, describe certain methods for identifying specific genes responsible for conferring a particular phenotype in a cell using specific long dsRNA molecules. Mello et al. International PCT Publication No. WO 01/29058, describe the identification of specific genes involved in dsRNA-mediated RNAi. Pachuck et al. International PCT Publication No. WO 00/63364, describe certain long (at least 200 nt) dsRNA constructs. Deschamps Depaillette et al. International PCT Publication No. WO 99/07409, describe specific compositions consisting of particular dsRNA molecules combined with certain anti-viral agents. Waterhouse et al. International PCT Publication No. 99/53050 and 1998, PNAS, 95, 13959-13964, describe certain methods for decreasing the phenotypic expression of a nucleic acid in plant cells using certain dsRNAs. Driscoll et al. International PCT Publication No. WO 01/49844, describe specific DNA expression constructs for use in facilitating gene silencing in targeted organisms.

Others have reported on various RNAi and gene-silencing systems. For example, Parrish et al. 2000, Molecular Cell 6: 1077-1087 describes specific chemically modified dsRNA constructs targeting the unc-22 gene of C. elegans. Grossniklaus, International PCT Publication No. WO 01/38551, describes certain methods for regulating polycomb gene expression in plants using certain dsRNAs. Churikov et al. International PCT Publication No. WO 01/42443, describe certain methods for modifying genetic characteristics of an organism using certain dsRNAs. Cogoni et al, International PCT Publication No. WO 01/53475, describe certain methods for isolating a Neurospora silencing gene and uses thereof. Reed et al. International PCT Publication No. WO 01/68836, describe certain methods for gene silencing in plants. Honer et al. International PCT Publication No. WO 01/70944, describe certain methods of drug screening using transgenic nematodes as Parkinson's Disease models using certain dsRNAs. Deak et al. International PCT Publication No. WO 01/72774, describe certain Drosophila-derived gene products that may be related to RNAi in Drosophila. Arndt et al. International PCT Publication No. WO 01/92513 describe certain methods for mediating gene suppression by using factors that enhance RNAi. Tuschl et al. International PCT Publication No. WO 02/44321, describe certain synthetic siRNA constructs. Pachuk et al. International PCT Publication No. WO 00/63364, and Satishchandran et al. International PCT Publication No. WO 01/04313, describe certain methods and compositions for inhibiting the function of certain polynucleotide sequences using certain long (over 250 bp), vector expressed dsRNAs. Echeverri et al. International PCT Publication No. WO 02/38805, describe certain C. elegans genes identified via RNAi. Kreutzer et al. International PCT Publications Nos. WO 02/055692, WO 02/055693, and EP 1144623 B1 describes certain methods for inhibiting gene expression using dsRNA. Graham et al. International PCT Publications Nos. WO 99/49029 and WO 01/70949, and AU 4037501 describe certain vector expressed siRNA molecules. Fire et al. U.S. Pat. No. 6,506,559, describe certain methods for inhibiting gene expression in vitro using certain long dsRNA (299 bp-1033 bp) constructs that mediate RNAi. Martinez et al. 2002, Cell, 110, 563-574, describe certain single-stranded siRNA constructs, including certain 5'-phosphorylated single-stranded siRNAs that mediate RNA interference in HeLa cells. Harborth et al. 2003, Antisense & Nucleic Acid Drug Development, 13, 83-105, describe certain chemically and structurally modified siRNA molecules. Chiu and Rana, 2003, RNA, 9, 1034-1048, describe certain chemically and structurally modified siRNA molecules. Woolf et al. International PCT Publication Nos. WO 03/064626 and WO 03/064625 describe certain chemically modified dsRNA constructs.

In various embodiments, the RNAi agent to HSF1 is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

Delivery of RNAi Agents

RNAi agents of the present disclosure can be delivered or introduced (e.g., to a cell in vitro or to a patient) by any means known in the art.

"Introducing into a cell," when referring to an iRNA, means facilitating or effecting uptake or absorption into the cell, as is understood by those skilled in the art. Absorption or uptake of an iRNA can occur through unaided diffusive or active cellular processes, or by auxiliary agents or devices. The meaning of this term is not limited to cells in vitro; an iRNA may also be "introduced into a cell," wherein the cell is part of a living organism. In such an instance, introduction into the cell will include the delivery to the organism. For example, for in vivo delivery, iRNA can be injected into a tissue site or administered systemically. In vivo delivery can also be by a beta-glucan delivery system, such as those described in U.S. Pat. Nos. 5,032,401 and 5,607,677, and U.S. Publication No. 2005/0281781 which are hereby incorporated by reference in their entirety. In vitro introduction into a cell includes methods known in the art such as electroporation and lipofection. Further approaches are described below or known in the art.

Delivery of RNAi agent to tissue is a problem both because the material must reach the target organ and must also enter the cytoplasm of target cells. RNA cannot penetrate cellular membranes, so systemic delivery of naked RNAi agent is unlikely to be successful. RNA is quickly degraded by RNAse activity in serum. For these reasons, other mechanisms to deliver RNAi agent to target cells has been devised. Methods known in the art include but are not limited to: viral delivery (retrovirus, adenovirus, lentivirus, baculovirus, AAV); liposomes (Lipofectamine, cationic DOTAP, neutral DOPC) or nanoparticles (cationic polymer, PEI), bacterial delivery (tkRNAi), and also chemical modification (LNA) of siRNA to improve stability. Xia et al. 2002 Nat. Biotechnol. 20 and Devroe et al. 2002. BMC Biotechnol. 2 1: 15, disclose incorporation of siRNA into a viral vector. Other systems for delivery of RNAi agents are contemplated, and the RNAi agents of the present disclosure can be delivered by various methods yet to be found and/or approved by the FDA or other regulatory authorities.

Liposomes have been used previously for drug delivery (e.g., delivery of a chemotherapeutic). Liposomes (e.g., cationic liposomes) are described in PCT publications WO02/100435A1, WO03/015757A1, and WO04029213A2; U.S. Pat. Nos. 5,962,016; 5,030,453; and 6,680,068; and U.S. Patent Application 2004/0208921. A process of making liposomes is also described in WO04/002453A1. Furthermore, neutral lipids have been incorporated into cationic liposomes (e.g., Farhood et al. 1995). Cationic liposomes have been used to deliver RNAi agent to various cell types (Sioud and Sorensen 2003; U.S. Patent Application 2004/0204377; Duxbury et al., 2004; Donze and Picard, 2002). Use of neutral liposomes disclosed in Miller et al. 1998, and U.S. Publ. 2003/0012812.

As used herein, the term "SNALP" refers to a stable nucleic acid-lipid particle. A SNALP represents a vesicle of lipids coating a reduced aqueous interior comprising a nucleic acid such as an iRNA or a plasmid from which an iRNA is transcribed. SNALPs are described, e.g., in U.S. Patent Application Publication Nos. 20060240093, 20070135372, and in International Application No. WO 2009082817. These applications are incorporated herein by reference in their entirety.

Chemical transfection using lipid-based, amine-based and polymer-based techniques, is disclosed in products from Ambion Inc., Austin, Tex.; and Novagen, EMD Biosciences, Inc, an Affiliate of Merck KGaA, Darmstadt, Germany); Ovcharenko D (2003) "Efficient delivery of siRNAs to human primary cells." Ambion TechNotes 10 (5): 15-16). Additionally, Song et al. (Nat. Med. published online (Fete 10, 2003) doi: 10.1038/nm828) and others [Caplen et al. 2001 Proc. Natl. Acad. Sci. (USA), 98: 9742-9747; and McCaffrey et al. Nature 414: 34-39] disclose that liver cells can be efficiently transfected by injection of the siRNA into a mammal's circulatory system.

A variety of molecules have been used for cell-specific RNAi agent delivery. For example, the nucleic acid-condensing property of protamine has been combined with specific antibodies to deliver siRNAs. Song et al. 2005 Nat. Biotech. 23: 709-717. The self-assembly PEGylated polycation polyethylenimine (PEI) has also been used to condense and protect siRNAs. Schiffelers et al. 2004 Nucl. Acids Res. 32: e149, 1 41-1 10.

The siRNA-containing nanoparticles were then successfully delivered to integrin-overexpressing tumor neovasculature. Hu-Lieskovan et al. 2005 Cancer Res. 65: 8984-8992.

The RNAi agents of the present disclosure can be delivered via, for example, Lipid nanoparticles (LNP); neutral liposomes (NL); polymer nanoparticles; double-stranded RNA binding motifs (dsRBMs); or via modification of the RNAi agent (e.g., covalent attachment to the dsRNA).

Lipid nanoparticles (LNP) are self-assembling cationic lipid based systems. These can comprise, for example, a neutral lipid (the liposome base); a cationic lipid (for siRNA loading); cholesterol (for stabilizing the liposomes); and PEG-lipid (for stabilizing the formulation, charge shielding and extended circulation in the bloodstream). The cationic lipid can comprise, for example, a headgroup, a linker, a tail and a cholesterol tail. The LNP can have, for example, good tumor delivery, extended circulation in the blood, small particles (e.g., less than 100 nm), and stability in the tumor microenvironment (which has low pH and is hypoxic).

Neutral liposomes (NL) are non-cationic lipid based particles.

Polymer nanoparticles are self-assembling polymer-based particles.

Double-stranded RNA binding motifs (dsRBMs) are self-assembling RNA binding proteins, which will need modifications.

RNAi Agents to HSF1 siRNAs that are particularly useful for this disclosure include those which can bind specifically to a region of the HSF1 mRNA, and have one or more of the following qualities: binding in the coding segment of HSF1; binding at or near the junction of the 5' untranslated region and the start of the coding segment; binding at or near the translational start site of the mRNA; binding at or near junctions of exons and introns; little or no binding to the mRNAs of other genes (little or no "off-target effects"); binding to the HSF1 mRNA in or near a region or regions that is not double-stranded or a stem region, e.g., in a loop or single-stranded portion; eliciting little or no immunogenicity; binding in a segment of the HSF1 mRNA sequence which is conserved among various animal species (including human, mouse, rat, cynomolgus monkey, etc.), as the presence of a conserved sequence facilitates testing using various laboratory animals; binding to double-stranded region(s) of the mRNA; binding to an AT-rich region (e.g., at least about 50, 51, 52, 53, 54, 55, 56, 57, 58, 59, or 60% AT-rich); and lacking particular sequences known or suspected to decrease siRNA activity, e.g., the presence of a GG sequence at the 5' end, which may decrease separation of the double-stranded portion of the siRNA.

RNAi agents can be designed as HSF1 RNAi agents which bind to and assist in degradation of HSF1 mRNA. The anti-HSF1 RNAi agents can be designed to bind to the coding segment or non-coding segment (e.g., the 5' or 3' untranslated regions, or UTRs). Preferably the RNAi agent binds to the coding segment of the mRNA. The RNAi agents can have double-stranded regions of, for example, about 17, 18, 19, 20, 21, 22, 23, or 24 bp. Preferably the RNAi agent comprises about 19, 20 or 21 bp. The RNAi agents can be longer (e.g., up to 49 bp), as incorporated into a construct suitable for shortening by the Dicer complex. The RNAi can also be incorporated into a longer construct for expression prior to further shortening and processing.

Sense and Antisense Strand of HSF1 RNAi Agents

The RNAi agents comprise a first strand and a second strand. In one embodiment, the first and second strands are a sense strand and an antisense strand, respectively. In other embodiments, the first and second strands are an antisense and sense strand, respectively. The first strand thus can comprise a sense or antisense strand of any sequence disclosed herein, or a variant sequence thereof comprising 15 contiguous nucleotides with up to 3 mismatches; and the second strand can thus comprise the corresponding antisense or sense strand of any sequence disclosed herein, or a variant sequence thereof comprising 15 contiguous nucleotides with up to 3 mismatches.

The term "antisense strand" refers to the strand of an iRNA, e.g., a dsRNA, which includes a region that is substantially complementary to a target sequence. As used herein, the term "region of complementarity" refers to the region on the antisense strand that is substantially complementary to a sequence, for example a target sequence, as defined herein. Where the region of complementarity is not fully complementary to the target sequence, the mismatches may be in the internal or terminal regions of the molecule. Generally, the most tolerated mismatches are in the terminal regions, e.g., within 5, 4, 3, or 2 nucleotides of the 5' and/or 3' terminus.

The term "sense strand," as used herein, refers to the strand of an iRNA that includes a region that is substantially complementary to a region of the antisense strand as that term is defined herein.

Overhangs and Blunt Ends

The RNAi agents can have 0, 1, or 2 overhangs; in the case of 0 nt overhangs, both ends are blunt-ended. An RNAi agent can have 0, 1 or 2 blunt ends. In a "blunt-ended RNAi agent" no strands contain unpaired nucleotides at that end; thus a blunt-ended molecule lacks either 3' or 5' single-stranded nucleotide overhangs.

As used herein, the term "overhang" or "nucleotide overhang" refer to at least one unpaired nucleotide that protrudes from the duplex structure of an iRNA, e.g., a dsRNA. For example, when a 3'-end of one strand of a dsRNA extends beyond the 5'-end of the other strand, or vice versa, there is an overhang. A dsRNA can comprise an overhang of at least one nucleotide; alternatively the overhang can comprise at least 2 nt, at least 3 nt, at least 4 nt, at least 5 nt or more. An overhang can comprise or consist of a nucleotide/nucleoside analog, including a deoxynucleotide/nucleoside. The overhang(s) may be on the sense strand, the antisense strand or any combination thereof. The nucleotide(s) of an overhang can be present on the 5' end, 3' end or both ends of either an antisense or sense strand of a dsRNA.

The terms "blunt" or "blunt-ended" as used herein in reference to a dsRNA mean that there are no unpaired nucleotides or nucleotide analogs at a given terminal end of a dsRNA, i.e., no nucleotide overhang. One or both ends of a dsRNA can be blunt. Where both ends of a dsRNA are blunt, the dsRNA is said to be blunt ended. To be clear, a "blunt ended" dsRNA is a dsRNA that is blunt at both ends, i.e., no nucleotide overhang at either end of the molecule. Most often such a molecule will be double-stranded over its entire length.

In one embodiment, a blunt end of an RNAi duplex is chemically modified by the addition of a 3' cap, e.g., those described in WO 2005/021749 and WO 2007/128477. In such embodiments, the 3' caps are non-nucleotidic, and thus do not constitute an overhang.

The mRNA sequence of a gene may vary from individual to individual, especially at wobble positions within the coding segment, or in the untranslated region; individuals may also differ from each other in coding sequence, resulting in additional differences in mRNA and corresponding RNAi agent sequence. RNAi agents can also be modified in sequence to reduce immunogenicity, binding to undesired genes (e.g., "off-target effects") or to increase stability in the blood. (These sequence variants are independent of chemical modification of the bases or 5' or 3' or other end-caps of the RNAi agents.)

Example anti-HSF1 RNAi agents include those which bind to an HSF1 gene provided herein. Example siRNAs to HSF1 are provided in any one or more of Tables 1, 2, 3, 3A, 8, 9A and 9B.

Measuring the Effect of an RNAi Agent on HSF1 Activity, Level and/or Expression

Any method known in the art can be use to measure changes in HSF1 activity, level and/or expression induced by a HSF1 siRNA. Measurements can be performed at multiple timepoints, prior to, during and after administration of the siRNA, to determine the effect of the siRNA.

The RNAi agents of the present disclosure silence, inhibit the expression of, down-regulate the expression of, and/or suppress the expression of HSF1.

The terms "silence," "inhibit the expression of," "down-regulate the expression of," "suppress the expression of," and the like, in so far as they refer to a HSF1 gene, herein refer to the at least partial suppression of the expression of a HSF1 gene, as manifested by a reduction of the amount of HSF1 mRNA which may be isolated from or detected in a first cell or group of cells in which a HSF1 gene is transcribed and which has or have been treated such that the expression of a HSF1 gene is inhibited, as compared to a second cell or group of cells substantially identical to the first cell or group of cells but which has or have not been so treated (control cells). The degree of inhibition is usually expressed in terms of $$\frac{(mRNA \text{ in control cells}) - (mRNA \text{ in treated cells})}{(mRNA \text{ in control cells})} \cdot 100\% \quad \text{(Equation 1)}$$

Alternatively, the degree of inhibition may be given in terms of a reduction of a parameter that is functionally linked to HSF1 gene expression, e.g., the amount of protein encoded by a HSF1 gene, or the number of cells displaying a certain phenotype, e.g., modulation of expression of a gene (e.g., HSP70) whose expression is mediated in whole or in part by HSF1. In principle, HSF1 gene silencing may be determined in any cell expressing HSF1, either constitutively or by genomic engineering, and by any appropriate assay. However, when a reference or control is needed in order to determine whether a given iRNA inhibits the expression of HSF1 by a certain degree and therefore is encompassed by the instant disclosure, the assays provided in the Examples below shall serve as such reference.

For example, in certain instances, expression of a HSF1 gene is suppressed by at least about 10%, 15%, 20%, 25%, 30%, 35%, 40%, 45%, or 50% by administration of an iRNA featured in the disclosure. In some embodiments, a HSF1 gene is suppressed by at least about 60%, 70%, or 80% by administration of an iRNA featured in the disclosure. In some embodiments, a HSF1 gene is suppressed by at least about 85%, 90%, or 95% or more by administration of an iRNA as described herein.

Treatments Involving HSF1 RNAi Agents

As used herein in the context of HSF1 expression, the terms "treat," "treatment," and the like, refer to relief from or alleviation of pathological processes mediated by HSF1 expression. In the context of the present disclosure insofar as it relates to any of the other conditions recited herein below (other than pathological processes mediated by HSF1 expression), the terms "treat," "treatment," and the like mean to relieve or alleviate at least one symptom associated with such condition, or to slow or reverse the progression or anticipated progression of such condition, such as slowing the progression of a lipid disorder, such as atherosclerosis.

By "lower" in the context of a disease marker or symptom is meant a statistically significant decrease in such level. The decrease can be, for example, at least 10%, at least 20%, at least 30%, at least 40% or more. If, for a particular disease, or for an individual suffering from a particular disease, the levels or expression of HSF1 are elevated, treatment with an HSF1 RNAi agent of the present disclosure can preferably reduce the level or expression of HSF1 to a level considered in the literature as within the range of normal for an individual without such disorder.

The level or expression of HSF1 can be measured by evaluation of mRNA (e.g., via Northern blots or PCR), or protein (e.g., Western blots). The effect of an RNAi agent on HSF1 expression can be determined by measuring HSF1 gene transcription rates (e.g., via Northern blots; or reverse transcriptase polymerase chain reaction or real-time polymerase chain reaction). RT-PCR has been used to show that mRNA levels of HSF1 are high in kidney, pancreas and prostate, and medium in liver and spleen. Brauner-Osborne et al. 2001. Biochim. Biophys. Acta 1518: 237-248. Direct measurements can be made of levels of HSF1 (which is expressed by the cell surface), e.g. by Western blots of tissues in which HSF1 is expressed.

In another embodiment of the disclosure, the compositions comprising a HSF1 RNAi agent can be administered to non-human animals. For example, the compositions can be given to chickens, turkeys, livestock animals (such as sheep, pigs, horses, cattle, etc.), companion animals (e.g., cats and dogs) and can have efficacy in treatment of cancer and viral diseases. In each case, the RNAi agent to HSF1 would be selected to match the sequence of the HSF1 of the genome of the animal, and to, preferably, contain at least 1 nt mismatch from all other genes in that animal's genome.

By "treatment" is meant prophylaxis, therapy, cure, or any other change in a patient's condition indicating improvement or absence of degradation of physical condition. By "treatment" is meant treatment of HSF1-related disease (e.g., cancer or viral disease), or any appropriate treatment of any other ailment the patient has. As used herein, the terms "treatment" and "treat" refer to both prophylactic or preventative treatment and curative or disease-modifying treatment, including treatment of patients at risk of contracting a disease or suspected of having a disease, as well as patients already ill or diagnosed as suffering from a condition. The terms "treatment" and "treat" also refer to the maintenance and/or promotion of health in an individual not suffering from a disease but who may be susceptible to developing an unhealthy condition, such as nitrogen imbalance or muscle loss. In one embodiment, "treatment" does not encompass prevention of a disease state. Thus, the present disclosure is useful for suppressing expression of HSF1 and/or treating an HSF1-related disease in an individual afflicted by an HSF1-related disease, or an individual susceptible to an HSF1-related disease. An individual "afflicted" by an HSF1-related disease has demonstrated detectable symptoms characteristics of the disease, or had otherwise been shown clinically to have been exposed to or to carry HSF1-related disease pathogens or markers. As non-limiting examples, an individual afflicted by an HSF1-related disease can show outward symptoms; or can show no outward symptoms but can be shown with a clinical test to carry protein markers associated with an HSF1-related disease, or proteins or genetic material associated with a pathogen in the blood.

An "effective amount" or a "therapeutically effective amount" is an amount that treats a disease or medical condition of an individual, or, more generally, provides a nutritional, physiological or medical benefit to an individual. As used herein, the phrases "therapeutically effective amount" and "prophylactically effective amount" refer to an amount that provides a therapeutic benefit in the treatment, prevention, or management of pathological processes mediated by HSF1 expression or an overt symptom of pathological processes mediated by HSF1 expression. The specific amount that is therapeutically effective can be readily determined by an ordinary medical practitioner, and may vary depending on factors known in the art, such as, e.g., the type of pathological processes mediated by HSF1 expression, the patient's history and age, the stage of pathological processes mediated by HSF1 expression, and administration of other agents that inhibit pathological processes mediated by HSF1.

In various embodiments of the disclosure, the patient is at least about 1, 5, 10, 20, 30, 40, 50, 55, 60, 65, 70, or 75 years of age. In various embodiments, the patient is no more than about 1, 5, 10, 20, 30, 40, 50, 55, 60, 65, 70, 75, 80, 90, or 100 years of age. In various embodiments the patient has a body weight of at least about 20, 30, 40, 50, 60, 70, 80, 90, 100, 120, 140, 160, 180, 200, 220, 240, 260, 280, 300, 320, 340, 360, 380 or 400 lbs. In various embodiments, the patient has a body weight of no more than about 20, 30, 40, 50, 60, 70, 80, 90, 100, 120, 140, 160, 180, 200, 220, 240, 260, 280, 300, 320, 340, 360, 380 or 400 lbs.

In various embodiments of the disclosure, the dosage [measuring only the active ingredient(s)] can be at least about 1, 5, 10, 25, 50, 100, 200, 250, 300, 250, 400, 450, 500, 550, 600, 650, 700, 750, 800, 850, 900, 950 or 1000 ng, 1, 5, 10, 25, 50, 100, 200, 250, 300, 250, 400, 450, 500, 550, 600, 650, 700, 750, 800, 850, 900, 950 or 1000 micrograms, 1, 5, 10, 25, 50, 100, 200, 250, 300, 250, 400, 450, 500, 550, 600, 650, 700, 750, 800, 850, 900, 950 or 1000 mg. In various embodiments, the dosage can be no more than about 10, 25, 50, 100, 200, 250, 300, 250, 400, 450, 500, 550, 600, 650, 700, 750, 800, 850, 900, 950 or 1000 mg. In various embodiments, the dosage can be administered at least more than once a day, daily, more than once a weekly, weekly, bi-weekly, monthly, and/or every 2, 3, 4, 5, 6, 7, 8, 9, 10, 11 or 12 months, or a combination thereof.

In various embodiments, the dosage is correlated to the body weight or body surface area of the individual. The actual dosage level can be varied to obtain an amount of active agent which is effective for a particular patient, composition and mode of administration, without being toxic to the patient. The selected dose will depend on a variety of pharmacokinetic factors, including the activity of the particular RNAi agent employed, the route of administration, the rate of excretion of the RNAi agent, the duration of the treatment, other drugs, compounds and/or materials used in combination with the RNAi agent, the age, sex, weight, condition, general health and prior medical history of the patient, and like factors well known in the medical arts. A physician or veterinarian having ordinary skill in the art can readily determine the effective amount of the RNAi agent required. A suitable dose will be that amount which is the lowest dose effective to produce a therapeutic effect, or a dose low enough to produce a therapeutic effect without causing side effects.

Pharmaceutical Compositions Comprising a HSF1 RNAi Agent

As used herein, a "pharmaceutical composition" comprises a pharmacologically effective amount of an iRNA and a pharmaceutically acceptable carrier. As used herein, "pharmacologically effective amount," "therapeutically effective amount" or simply "effective amount" refers to that amount of an iRNA effective to produce the intended pharmacological, therapeutic or preventive result. For example, if a given clinical treatment is considered effective when there is at least a 10% reduction in a measurable parameter associated with a disease or disorder, a therapeutically effective amount of a drug for the treatment of that disease or disorder is the amount necessary to effect at least a 10% reduction in that parameter. For example, a therapeutically effective amount of an iRNA targeting HSF1 can reduce HSF1 protein levels by at least 10%.

The term "pharmaceutically acceptable carrier" refers to a carrier for administration of a therapeutic agent. Such carriers include, but are not limited to, saline, buffered saline, dextrose, water, glycerol, ethanol, and combinations thereof. The term specifically excludes cell culture medium. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. Agents included in drug formulations are described herein.

The pharmaceutical compositions comprising a HSF1 RNAi agent can be in solid form, for example, powders, granules, tablets, pills, gelcaps, gelatin capsules, liposomes, suppositories, chewable forms, or patches. The pharmaceutical compositions comprising a HSF1 RNAi agent can also be presented in liquid form, for example, solutions, emulsions, suspensions, elixirs, or syrups. Appropriate liquid supports can be, for example, water, organic solvents such as polyol, such as glycerol or glycols, including propylene glycol and polyethylene glycol, or ethanol, Cremophor EL, or mixtures thereof, in varying proportions, in water. The compositions can comprise nano-sized amorphous or crystalline granules coated with albumin or a surfactant.

Appropriate supports can include, for example, antibacterial and antifungal agents, buffering agents, calcium phosphate, cellulose, methyl cellulose, chlorobutanol, cocoa butter, colorings, dextrin, emulsifiers, enteric coatings, flavorings, gelatin, isotonic agents, lecithin, magnesium stearate, perfuming agents, polyalcohols such as mannitol, injectable organic esters such as ethyl oleate, paraben, phenol sorbic acid, polyethylene glycol, polyvinylpyrrolidine, phosphate buffered saline (PBS), preserving agents, propylene glycol, sodium carboxymethylcellulose, sodium chloride, sorbitol, various sugars (including, but not limited to, sucrose, fructose, galactose, lactose and trehalose), starch, suppository wax, talc, vegetable oils, such as olive oil and corn oil, vitamins, wax, and/or wetting agents. For HSF1 RNAi agents, a particular support comprises dextran and water, e.g. 5% dextrose in water (D5W).

The biologically inert portion of the pharmaceutical composition can optionally be erodible, allowing timed release of the RNAi agent.

The pharmaceutical composition comprising a HSF1 can be administered by buccal, inhalation (including insufflation and deep inhalation), nasal, oral, parenteral, implant, injection or infusion via epidural, intra-arterial, intra-articular, intracapsular, intracardiac, intracerebroventricular, intracranial, intradermal, intramuscular, intraorbital, intraperitoneal, intraspinal, intrasternal, intrathecal, intravenous, subarachnoid, subcapsular, subcutaneous, subcuticular, transendothelial, transtracheal, transvascular, rectal, sublingual, topical, and/or vaginal routes. This may be by injection, infusion, dermal patch, or any other method known in the art. The formulation can be powdered, nebulized, aerosolized, granulized or otherwise appropriately prepared for delivery. The administration, if liquid, may be slow or via bolus, though, under some circumstances known in the art, bolus injections may lead to loss of material through the kidneys.

The HSF1 RNAi agents can be administered with medical devices known in the art. For example, in a particular specific embodiment, an RNAi agent can be administered with a needleless hypodermic injection device, such as the devices disclosed in U.S. Pat. No. 5,399,163, 5,383,851, 5,312,335, 5,064,413, 4,941,880, 4,790,824, or 4,596,556. Examples of well-known implants and modules useful in the present disclosure include: U.S. Pat. No. 4,487,603, which discloses an implantable micro-infusion pump for dispensing medication at a controlled rate; U.S. Pat. No. 4,486,194, which discloses a therapeutic device for administering medications through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system. Many other such implants, delivery systems, and modules are known to those skilled in the art.

In certain embodiments, RNAi agents can be formulated to ensure proper distribution in vivo. For example, the blood-brain barrier (BBB) excludes many highly hydrophilic compounds. To ensure that the HSF1 RNAi agents cross the BBB (if desired), they can be formulated, for example, in liposomes. For methods of manufacturing liposomes, see, e.g., U.S. Pat. Nos. 4,522,811; 5,374,548; and 5,399,331. The liposomes may comprise one or more moieties which are selectively transported into specific cells or organs, thus enhance targeted drug delivery (see, e.g., V. V. Ranade (1989) *J. Clin. Pharmacol.* 29: 685). Example targeting moieties include folate or biotin (see, e.g., U.S. Pat. No. 5,416,016 to Low et al.); mannosides (Umezawa et al., (1988) *Biochem. Biophys. Res. Commun.* 153: 1038); antibodies (P. G. Bloeman et al. (1995) *FEBS Lett.* 357: 140; M. Owais et al. (1995) *Antimicrob. Agents Chemother.* 39: 180); surfactant protein A receptor (Briscoe et al. (1995) *Am. J. Physiol.* 1233: 134), different species of which may comprise the formulations of the disclosures, as well as components of the invented molecules; p120 (Schreier et al. (1994) *J. Biol. Chem.* 269: 9090); see also K. Keinanen; M. L. Laukkanen (1994) *FEBS Lett.* 346: 123; J. J. Killion; I. J. Fidler (1994) *Immunomethods* 4: 273.

Particular Specific Embodiments

In a particular specific embodiment, the present disclosure is a composition comprising one or more HSF1 RNAi agents.

In one embodiment, the disclosure comprises or consists of: AD-20278, or modified or unmodified variants thereof.
In one embodiment, the disclosure comprises or consists of: AD-20279, or modified or unmodified variants thereof.
In one embodiment, the disclosure comprises or consists of: AD-20280, or modified or unmodified variants thereof.
In one embodiment, the disclosure comprises or consists of: AD-20281, or modified or unmodified variants thereof.
In one embodiment, the disclosure comprises or consists of: AD-20282, or modified or unmodified variants thereof.
In one embodiment, the disclosure comprises or consists of: AD-20283, or modified or unmodified variants thereof.
In one embodiment, the disclosure comprises or consists of: AD-20303, or modified or unmodified variants thereof.
In one embodiment, the disclosure comprises or consists of: AD-20313, or modified or unmodified variants thereof.
In one embodiment, the disclosure comprises or consists of: AD-20315, or modified or unmodified variants thereof.
In one embodiment, the disclosure comprises or consists of: AD-20348, or modified or unmodified variants thereof.
In one embodiment, the disclosure comprises or consists of: AD-20362, or modified or unmodified variants thereof.
In one embodiment, the disclosure comprises or consists of: AD-20364, or modified or unmodified variants thereof.
In one embodiment, the disclosure comprises or consists of: AD-20365, or modified or unmodified variants thereof.
In one embodiment, the disclosure comprises or consists of: AD-20366, or modified or unmodified variants thereof.
In one embodiment, the disclosure comprises or consists of: AD-20373, or modified or unmodified variants thereof.
In one embodiment, the disclosure comprises or consists of: AD-20376, or modified or unmodified variants thereof.
In one embodiment, the disclosure comprises or consists of: AD-20377, or modified or unmodified variants thereof.
In one embodiment, the disclosure comprises or consists of: AD-20378, or modified or unmodified variants thereof.
In one embodiment, the disclosure comprises or consists of: AD-20386, or modified or unmodified variants thereof.
In one embodiment, the disclosure comprises or consists of: AD-20389, or modified or unmodified variants thereof.
In one embodiment, the disclosure comprises or consists of: AD-20391, or modified or unmodified variants thereof.
In one embodiment, the disclosure comprises or consists of: AD-20392, or modified or unmodified variants thereof.
In one embodiment, the disclosure comprises or consists of: AD-20397, or modified or unmodified variants thereof.
In one embodiment, the disclosure comprises or consists of: AD-20398, or modified or unmodified variants thereof.
In one embodiment, the disclosure comprises or consists of: AD-20399, or modified or unmodified variants thereof.
In one embodiment, the disclosure comprises or consists of: AD-20401, or modified or unmodified variants thereof.
In one embodiment, the disclosure comprises or consists of: AD-20402, or modified or unmodified variants thereof.
In one embodiment, the disclosure comprises or consists of: AD-20403, or modified or unmodified variants thereof.
In one embodiment, the disclosure comprises or consists of: AD-20404, or modified or unmodified variants thereof.
In one embodiment, the disclosure comprises or consists of: AD-20406, or modified or unmodified variants thereof.
In one embodiment, the disclosure comprises or consists of: AD-20407, or modified or unmodified variants thereof.
In one embodiment, the disclosure comprises or consists of: AD-20408, or modified or unmodified variants thereof.
In one embodiment, the disclosure comprises or consists of: AD-20409, or modified or unmodified variants thereof.
In one embodiment, the disclosure comprises or consists of: AD-20410, or modified or unmodified variants thereof.
In one embodiment, the disclosure comprises or consists of: AD-20411, or modified or unmodified variants thereof.
In one embodiment, the disclosure comprises or consists of: AD-20413, or modified or unmodified variants thereof.
In one embodiment, the disclosure comprises or consists of: AD-20422, or modified or unmodified variants thereof.
In one embodiment, the disclosure comprises or consists of: AD-20428, or modified or unmodified variants thereof.
In one embodiment, the disclosure comprises or consists of: AD-20434, or modified or unmodified variants thereof.
In one embodiment, the disclosure comprises or consists of: AD-20435, or modified or unmodified variants thereof.
In one embodiment, the disclosure comprises or consists of: AD-20437.4, or modified or unmodified variants thereof.
In one embodiment, the disclosure comprises or consists of: AD-20437, or modified or unmodified variants thereof.
In one embodiment, the disclosure comprises or consists of: AD-20438, or modified or unmodified variants thereof.
In one embodiment, the disclosure comprises or consists of: AD-20439, or modified or unmodified variants thereof.
In one embodiment, the disclosure comprises or consists of: AD-20487.7, or modified or unmodified variants thereof.
In one embodiment, the disclosure comprises or consists of: AD-20487, or modified or unmodified variants thereof.
In one embodiment, the disclosure comprises or consists of: AD-20488, or modified or unmodified variants thereof.
In one embodiment, the disclosure comprises or consists of: AD-20489.2, or modified or unmodified variants thereof.
In one embodiment, the disclosure comprises or consists of: AD-20489, or modified or unmodified variants thereof.
In one embodiment, the disclosure comprises or consists of: AD-20490, or modified or unmodified variants thereof.
In one embodiment, the disclosure comprises or consists of: AD-20491, or modified or unmodified variants thereof.
In one embodiment, the disclosure comprises or consists of: AD-20493, or modified or unmodified variants thereof.
In one embodiment, the disclosure comprises or consists of: AD-20495, or modified or unmodified variants thereof.
In one embodiment, the disclosure comprises or consists of: AD-20502, or modified or unmodified variants thereof.

In one embodiment, the disclosure comprises or consists of: AD-20507, or modified or unmodified variants thereof.

In one embodiment, the disclosure comprises or consists of: AD-20513, or modified or unmodified variants thereof.

In one embodiment, the disclosure comprises or consists of: AD-20527, or modified or unmodified variants thereof.

In one embodiment, the disclosure comprises or consists of: AD-20535, or modified or unmodified variants thereof.

In one embodiment, the disclosure comprises or consists of: AD-20544, or modified or unmodified variants thereof.

In one embodiment, the disclosure comprises or consists of: AD-20545, or modified or unmodified variants thereof.

In one embodiment, the disclosure comprises or consists of: AD-20546, or modified or unmodified variants thereof.

In one embodiment, the disclosure comprises or consists of: AD-20547, or modified or unmodified variants thereof.

In one embodiment, the disclosure comprises or consists of: AD-20548, or modified or unmodified variants thereof.

In one embodiment, the disclosure comprises or consists of: AD-20549, or modified or unmodified variants thereof.

In one embodiment, the disclosure comprises or consists of: AD-20552, or modified or unmodified variants thereof.

In one embodiment, the disclosure comprises or consists of: AD-20555, or modified or unmodified variants thereof.

In one embodiment, the disclosure comprises or consists of: AD-20556, or modified or unmodified variants thereof.

In one embodiment, the disclosure comprises or consists of: AD-20557, or modified or unmodified variants thereof.

In one embodiment, the disclosure comprises or consists of: AD-20558, or modified or unmodified variants thereof.

In one embodiment, the disclosure comprises or consists of: AD-20560.4, or modified or unmodified variants thereof.

In one embodiment, the disclosure comprises or consists of: AD-20560, or modified or unmodified variants thereof.

In one embodiment, the disclosure comprises or consists of: AD-20561, or modified or unmodified variants thereof.

In one embodiment, the disclosure comprises or consists of: AD-20562, or modified or unmodified variants thereof.

In one embodiment, the disclosure comprises or consists of: AD-20563, or modified or unmodified variants thereof.

In one embodiment, the disclosure comprises or consists of: AD-20564, or modified or unmodified variants thereof.

In one embodiment, the disclosure comprises or consists of: AD-20565, or modified or unmodified variants thereof.

In one embodiment, the disclosure comprises or consists of: AD-20566, or modified or unmodified variants thereof.

In one embodiment, the disclosure comprises or consists of: AD-20570, or modified or unmodified variants thereof.

In one embodiment, the disclosure comprises or consists of: AD-20572, or modified or unmodified variants thereof.

In one embodiment, the disclosure comprises or consists of: AD-20574, or modified or unmodified variants thereof.

In one embodiment, the disclosure comprises or consists of: AD-20575, or modified or unmodified variants thereof.

In one embodiment, the disclosure comprises or consists of: AD-20577, or modified or unmodified variants thereof.

In one embodiment, the disclosure comprises or consists of: AD-20578, or modified or unmodified variants thereof.

In one embodiment, the disclosure comprises or consists of: AD-20579, or modified or unmodified variants thereof.

In one embodiment, the disclosure comprises or consists of: AD-20580, or modified or unmodified variants thereof.

In one embodiment, the disclosure comprises or consists of: AD-20597, or modified or unmodified variants thereof.

In one embodiment, the disclosure comprises or consists of: AD-20598, or modified or unmodified variants thereof.

In one embodiment, the disclosure comprises or consists of: AD-20625, or modified or unmodified variants thereof.

In one embodiment, the disclosure comprises or consists of: AD-20626, or modified or unmodified variants thereof.

In one embodiment, the disclosure comprises or consists of: AD-20627, or modified or unmodified variants thereof.

In one embodiment, the disclosure comprises or consists of: AD-20633, or modified or unmodified variants thereof.

In one embodiment, the disclosure comprises or consists of: AD-20634, or modified or unmodified variants thereof.

In one embodiment, the disclosure comprises or consists of: AD-20640, or modified or unmodified variants thereof.

In one embodiment, the disclosure comprises or consists of: AD-20644, or modified or unmodified variants thereof.

In one embodiment, the disclosure comprises or consists of: AD-20646, or modified or unmodified variants thereof.

In one embodiment, the disclosure comprises or consists of: AD-20648, or modified or unmodified variants thereof.

In one embodiment, the disclosure comprises or consists of: AD-20650, or modified or unmodified variants thereof.

In one embodiment, the disclosure comprises or consists of: AD-20652, or modified or unmodified variants thereof.

In one embodiment, the disclosure comprises or consists of: AD-20653, or modified or unmodified variants thereof.

In one embodiment, the disclosure comprises or consists of: AD-20660, or modified or unmodified variants thereof.

In one embodiment, the disclosure comprises or consists of: AD-20661, or modified or unmodified variants thereof.

In one embodiment, the disclosure comprises or consists of: AD-20671, or modified or unmodified variants thereof.

In one embodiment, the disclosure comprises or consists of: AD-20693, or modified or unmodified variants thereof.

In one embodiment, the disclosure comprises or consists of: AD-20694, or modified or unmodified variants thereof.

In one embodiment, the disclosure comprises or consists of: AD-20700, or modified or unmodified variants thereof.

In one embodiment, the disclosure comprises or consists of: AD-20702, or modified or unmodified variants thereof.

In one embodiment, the disclosure comprises or consists of: AD-20707, or modified or unmodified variants thereof.

In one embodiment, the disclosure comprises or consists of: AD-20709, or modified or unmodified variants thereof.

In one embodiment, the disclosure comprises or consists of: AD-20710, or modified or unmodified variants thereof.

In one embodiment, the disclosure comprises or consists of: AD-20714, or modified or unmodified variants thereof.

In one embodiment, the disclosure comprises or consists of: AD-20716, or modified or unmodified variants thereof.

In one embodiment, the disclosure comprises or consists of: AD-20728, or modified or unmodified variants thereof.

In one embodiment, the disclosure comprises or consists of: AD-20730, or modified or unmodified variants thereof.

In one embodiment, the disclosure comprises or consists of: AD-20741, or modified or unmodified variants thereof.

In one embodiment, the disclosure comprises or consists of: AD-20764, or modified or unmodified variants thereof.

In one embodiment, the disclosure comprises or consists of: AD-20783, or modified or unmodified variants thereof.

In one embodiment, the disclosure comprises or consists of: AD-30071, or modified or unmodified variants thereof.

In one embodiment, the disclosure comprises or consists of: AD-36969, or modified or unmodified variants thereof.

In one embodiment, the disclosure comprises or consists of: AD-36970, or modified or unmodified variants thereof.

In one embodiment, the disclosure comprises or consists of: AD-37718, or modified or unmodified variants thereof.

In one embodiment, the disclosure comprises or consists of: AD-37719, or modified or unmodified variants thereof.
In one embodiment, the disclosure comprises or consists of: AD-37720, or modified or unmodified variants thereof.
In one embodiment, the disclosure comprises or consists of: AD-37721, or modified or unmodified variants thereof.
In one embodiment, the disclosure comprises or consists of: AD-37722, or modified or unmodified variants thereof.
In one embodiment, the disclosure comprises or consists of: AD-37723, or modified or unmodified variants thereof.
In one embodiment, the disclosure comprises or consists of: AD-37724, or modified or unmodified variants thereof.
In one embodiment, the disclosure comprises or consists of: AD-37725, or modified or unmodified variants thereof.
In one embodiment, the disclosure comprises or consists of: AD-37726, or modified or unmodified variants thereof.
In one embodiment, the disclosure comprises or consists of: AD-37727, or modified or unmodified variants thereof.
In one embodiment, the disclosure comprises or consists of: AD-37728, or modified or unmodified variants thereof.
In one embodiment, the disclosure comprises or consists of: AD-37729, or modified or unmodified variants thereof.
In one embodiment, the disclosure comprises or consists of: AD-37730, or modified or unmodified variants thereof.
In one embodiment, the disclosure comprises or consists of: AD-37731, or modified or unmodified variants thereof.
In one embodiment, the disclosure comprises or consists of: AD-37732, or modified or unmodified variants thereof.
In one embodiment, the disclosure comprises or consists of: AD-37733, or modified or unmodified variants thereof.
In one embodiment, the disclosure comprises or consists of: AD-37734, or modified or unmodified variants thereof.
In one embodiment, the disclosure comprises or consists of: AD-37735, or modified or unmodified variants thereof.
In one embodiment, the disclosure comprises or consists of: AD-30071.2, or modified or unmodified variants thereof.
In one embodiment, the disclosure comprises or consists of: AD-36969.2, or modified or unmodified variants thereof.
In one embodiment, the disclosure comprises or consists of: AD-36970.2, or modified or unmodified variants thereof.
In one embodiment, the disclosure comprises or consists of: AD-37718.1, or modified or unmodified variants thereof.
In one embodiment, the disclosure comprises or consists of: AD-37719.1, or modified or unmodified variants thereof.
In one embodiment, the disclosure comprises or consists of: AD-37720.1, or modified or unmodified variants thereof.
In one embodiment, the disclosure comprises or consists of: AD-37721.1, or modified or unmodified variants thereof.
In one embodiment, the disclosure comprises or consists of: AD-37722.1, or modified or unmodified variants thereof.
In one embodiment, the disclosure comprises or consists of: AD-37723.1, or modified or unmodified variants thereof.
In one embodiment, the disclosure comprises or consists of: AD-37724.1, or modified or unmodified variants thereof.
In one embodiment, the disclosure comprises or consists of: AD-37725.1, or modified or unmodified variants thereof.
In one embodiment, the disclosure comprises or consists of: AD-37726.1, or modified or unmodified variants thereof.
In one embodiment, the disclosure comprises or consists of: AD-37727.1, or modified or unmodified variants thereof.
In one embodiment, the disclosure comprises or consists of: AD-37728.1, or modified or unmodified variants thereof.
In one embodiment, the disclosure comprises or consists of: AD-37729.1, or modified or unmodified variants thereof.
In one embodiment, the disclosure comprises or consists of: AD-37730.1, or modified or unmodified variants thereof.
In one embodiment, the disclosure comprises or consists of: AD-37731.1, or modified or unmodified variants thereof.
In one embodiment, the disclosure comprises or consists of: AD-37732.1, or modified or unmodified variants thereof.
In one embodiment, the disclosure comprises or consists of: AD-37733.1, or modified or unmodified variants thereof.
In one embodiment, the disclosure comprises or consists of: AD-37734.1, or modified or unmodified variants thereof.
In one embodiment, the disclosure comprises or consists of: AD-37735.1, or modified or unmodified variants thereof.
In one embodiment, the disclosure comprises or consists of: AD-37736, or modified or unmodified variants thereof.
In one embodiment, the disclosure comprises or consists of: AD-37737, or modified or unmodified variants thereof.
In one embodiment, the disclosure comprises or consists of: AD-37738, or modified or unmodified variants thereof.
In one embodiment, the disclosure comprises or consists of: AD-37739, or modified or unmodified variants thereof.
In one embodiment, the disclosure comprises or consists of: AD-37740, or modified or unmodified variants thereof.
In one embodiment, the disclosure comprises or consists of: AD-37741, or modified or unmodified variants thereof.
In one embodiment, the disclosure comprises or consists of: AD-37742, or modified or unmodified variants thereof.

Additional Particular Specific Embodiments

In various embodiments, the disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of any one or more RNAi agent disclosed herein.

Various embodiments are further delineated below.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20278, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20279, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20280, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20281, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20282, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20283, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20303, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20313, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20315, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20348, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20362, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20364, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20365, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20366, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20373, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20376, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20377, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20378, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20386, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20389, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20391, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20392, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20397, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20398, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20399, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20401, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20402, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20403, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20404, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20406, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20407, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20408, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20409, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20410, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20411, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20413, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20422, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20428, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20434, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20435, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20437.4, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20437, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20438, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20439, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20487.7, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20487, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20488, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20489.2, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20489, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20490, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20491, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20493, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20495, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20502, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20507, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20513, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20527, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20535, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20544, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20545, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20546, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20547, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20548, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20549, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20552, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20555, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20556, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20557, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20558, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20560.4, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20560, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20561, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20562, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20563, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20564, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20565, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20566, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20570, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20572, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20574, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 con- The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20577, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20578, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20579, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20580, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20597, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20598, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20625, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20626, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20627, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20633, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20634, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20640, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20644, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20646, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20648, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20650, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20652, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20653, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20660, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20661, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20671, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20693, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20694, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20700, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20702, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20707, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20709, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20710, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20714, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20716, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20728, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20730, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20741, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20764, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-20783, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-30071 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-36969 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-36970 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37718 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37719 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37720 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37721 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37722 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37723 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37724 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37725 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37726 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37727 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37728 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37729 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37730 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37731 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37732 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37733 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37734 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37735 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37736 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37737 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37738 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37739 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37740 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37741 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37742 or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-30071.2, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-36969.2, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-36970.2, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37718.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37719.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37720.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37721.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37722.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37723.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37724.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37725.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37726.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37727.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37728.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37729.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37730.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37731.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37732.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37733.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37734.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37735.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37736.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37737.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37738.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37739.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37740.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37741.1, or modified or unmodified variants thereof.

The disclosure comprises a RNAi agent comprising a first and a second strand, wherein the first strand comprises at least 15 contiguous nucleotides differing by 0, 1, 2, or 3 nt from a first strand, and the second strand comprises at least 15 contiguous nucleotides differing by 0, 1, 2, or 3 nt from the second strand of: AD-37742.1, or modified or unmodified variants thereof.

Additional Particular Specific Embodiments

In various embodiments, the disclosure comprises a RNAi agent comprising a sense and an antisense strand, wherein the antisense strand comprises at least 15 contiguous nucleotides differing by 0, 1, 2, or 3 nt from the antisense strand of any RNAi agent disclosed herein.

Thus, in various embodiments

The disclosure comprises a RNAi agent comprising a sense and an antisense strand, wherein the antisense strand comprises at least 15 contiguous nucleotides differing by 0, 1, 2, or 3 nt from the antisense strand of any one or more of the following duplexes, or modified or unmodified variants thereof: AD-20278, AD-20279, AD-20280, AD-20281, AD-20282, AD-20283, AD-20296, AD-20300, AD-20303, AD-20312, AD-20313, AD-20315, AD-20344, AD-20345, AD-20348, AD-20349, AD-20353, AD-20362, AD-20364, AD-20365, AD-20366, AD-20373, AD-20374, AD-20376, AD-20377, AD-20378, AD-20379, AD-20380, AD-20386, AD-20387, AD-20388, AD-20389, AD-20390, AD-20391, AD-20392, AD-20393, AD-20395, AD-20396, AD-20397, AD-20398, AD-20399, AD-20401, AD-20402, AD-20403, AD-20404, AD-20406, AD-20407, AD-20408, AD-20409, AD-20410, AD-20411, AD-20413, AD-20421, AD-20422, AD-20424, AD-20426, AD-20426, AD-20427, AD-20428, AD-20433, AD-20434, AD-20435, AD-20436, AD-20437, AD-20438, AD-20439, AD-20487, AD-20488, AD-20489, AD-20490, AD-20491, AD-20492, AD-20493, AD-20494, AD-20495, AD-20501, AD-20502, AD-20504, AD-20506, AD-20507, AD-20510, AD-20511, AD-20513, AD-20527, AD-20530 AD-20531, AD-20534, AD-20535, AD-20538, AD-20542, AD-20543, AD-20544, AD-20545, AD-20546, AD-20547, AD-20548, AD-20549, AD-20550, AD-20552, AD-20554, AD-20555, AD-20556, AD-20557, AD-20558, AD-20559, AD-20560, AD-20561, AD-20562, AD-20563, AD-20564, AD-20565, AD-20566, AD-20567, AD-20570, AD-20572, AD-20574, AD-20575, AD-20576, AD-20577, AD-20578, AD-20579, AD-20580, AD-20581, AD-20582, AD-20625, AD-20626, AD-20627, AD-20628, AD-20629, AD-20630, AD-20631, AD-20632, AD-20633, AD-20635, AD-20638, AD-20639, AD-20640, AD-20642, AD-20643, AD-20644, AD-20646, AD-20647, AD-20648, AD-20650, AD-20652, AD-20653, AD-20656, AD-20658, AD-20659, AD-20660, AD-20661, AD-20662, AD-20670, AD-20671, AD-20672, AD-20676, AD-20678, AD-20693, AD-20694, AD-20695, AD-20700, AD-20701, AD-20702, AD-20703, AD-20705, AD-20706, AD-20707, AD-20708, AD-20709, AD-20710, AD-20711, AD-20713, AD-20714, AD-20715, AD-20716, AD-20718, AD-20720, AD-20728, AD-20730, AD-20731, AD-20741, AD-20742, AD-20743, AD-20744, AD-20748, AD-20751, AD-20752, AD-20754, AD-20764, AD-20765, AD-20766, AD-20783, AD-20784, AD-20785, AD-20786, AD-20790, AD-20801, or modified or unmodified variants thereof.

In various embodiments, the disclosure comprises a RNAi agent comprising a sense and an antisense strand, wherein the antisense strand comprises at least 15 contiguous nucleotides differing by 0, 1, 2, or 3 nt from the antisense strand of any RNAi agent disclosed herein, or modified or unmodified variants thereof, wherein the antisense strand optionally further comprises 0, 1, 2, 3, 4, 5, 6, 7, 8, 9, or 10 or more nt (or any range thereof, e.g., 0-1, 1-2, 1-3, 1-4 nt, etc.).

Thus, in various embodiments, the disclosure comprises a RNAi agent comprising a sense and an antisense strand, wherein the antisense strand comprises at least 15 contiguous nucleotides differing by 0, 1, 2, or 3 nt from the antisense strand of: AD-20278, AD-20279, AD-20280, AD-20281, AD-20282, AD-20283, AD-20303, AD-20313, AD-20315, AD-20348, AD-20362, AD-20364, AD-20365, AD-20366, AD-20373, AD-20376, AD-20377, AD-20378, AD-20386, AD-20389, AD-20391, AD-20392, AD-20397, AD-20398, AD-20399, AD-20401, AD-20402, AD-20403, AD-20404, AD-20406, AD-20407, AD-20408, AD-20409, AD-20410, AD-20411, AD-20413, AD-20422, AD-20428, AD-20434, AD-20435, AD-20437, AD-20437, AD-20438, AD-20439, AD-20487, AD-20487, AD-20488, AD-20489, AD-20489, AD-20490, AD-20491, AD-20493, AD-20495, AD-20502, AD-20507, AD-20513, AD-20527, AD-20535, AD-20544, AD-20545, AD-20546, AD-20547, AD-20548, AD-20549, AD-20552, AD-20555, AD-20556, AD-20557, AD-20558, AD-20560, AD-20560, AD-20561, AD-20562, AD-20563, AD-20564, AD-20565, AD-20566, AD-20570, AD-20572, AD-20574, AD-20575, AD-20577, AD-20578, AD-20579, AD-20580, AD-20597, AD-20598, AD-20625, AD-20626, AD-20627, AD-20633, AD-20634, AD-20640, AD-20644, AD-20646, AD-20648, AD-20650, AD-20652, AD-20653, AD-20660, AD-20661, AD-20671, AD-20693, AD-20694, AD-20700, AD-20702, AD-20707, AD-20709, AD-20710, AD-20714, AD-20716, AD-20728, AD-20730, AD-20741, AD-20764, AD-20783, AD-30071, AD-36969, AD-36970, AD-37718, AD-37719, AD-37720, AD-37721, AD-37722, AD-37723, AD-37724, AD-37725, AD-37726, AD-37727, AD-37728, AD-37729, AD-37730, AD-37731, AD-37732, AD-37733, AD-37734, AD-37735, AD-37736, AD-37737, AD-37738, AD-37739, AD-37740, AD-37741, AD-37742, or modified or unmodified variants thereof, wherein the antisense strand optionally further comprises 0, 1, 2, 3, 4, 5, 6, 7, 8, 9, or 10 or more nt (or any range thereof, e.g., 0-1, 1-2, 1-3, 1-4 nt, etc.).

In one embodiment, the disclosure comprises any one or more RNAi agent listed herein.

Additional Particular Embodiments

In various embodiments, the disclosure comprises a RNAi agent comprising a sense and an antisense strand, wherein the antisense strand comprises or consists of the antisense strand of any RNAi agent disclosed herein.

Thus, the following are provided as examples of the various embodiments.

The disclosure comprises a RNAi agent comprising a sense and an antisense strand, wherein the antisense strand comprises or consists of the antisense strand of: AD-20278, AD-20279, AD-20280, AD-20281, AD-20282, AD-20283, AD-20296, AD-20300, AD-20303, AD-20312, AD-20313, AD-20315, AD-20344, AD-20345, AD-20348, AD-20349, AD-20353, AD-20362, AD-20364, AD-20365, AD-20366, AD-20373, AD-20374, AD-20376, AD-20377, AD-20378, AD-20379, AD-20380, AD-20386, AD-20387, AD-20388, AD-20389, AD-20390, AD-20391, AD-20392, AD-20393, AD-20395, AD-20396, AD-20397, AD-20398, AD-20399, AD-20401, AD-20402, AD-20403, AD-20404, AD-20406, AD-20407, AD-20408, AD-20409, AD-20410, AD-20411, AD-20413, AD-20421, AD-20422, AD-20424, AD-20426, AD-20426, AD-20427, AD-20428, AD-20433, AD-20434, AD-20435, AD-20436, AD-20437, AD-20438, AD-20439, AD-20487, AD-20488, AD-20489, AD-20490, AD-20491, AD-20492, AD-20493, AD-20494, AD-20495, AD-20501, AD-20502, AD-20504, AD-20506, AD-20507, AD-20510, AD-20511, AD-20513, AD-20527, AD-20530 AD-20531, AD-20534, AD-20535, AD-20538, AD-20542, AD-20543, AD-20544, AD-20545, AD-20546, AD-20547, AD-20548, AD-20549, AD-20550, AD-20552, AD-20554, AD-20555, AD-20556, AD-20557, AD-20558, AD-20559, AD-20560, AD-20561, AD-20562, AD-20563, AD-20564, AD-20565, AD-20566, AD-20567, AD-20570, AD-20572, AD-20574, AD-20575, AD-20576, AD-20577, AD-20578, AD-20579, AD-20580, AD-20581, AD-20582, AD-20625, AD-20626,

Additional Particular Specific Embodiments

Certain RNAi agents to HSF1 are disclosed in the scientific literature, e.g., in Rossi et al. 2006 Cancer Res. 66:7678-85;

Dokladny et al. 2008 Am. J. Pathology 72:659-70; Jacobs et al. 2007 J. Biol. Chem. 282: 33412-20; Page et al. 2006 Mol. Biosystems 2:627-39; Zhao et al. 2007 Diabetes 56: 1436-1444; and Du et al. 2009 J. Cell. Phys. 218:631-637. The compositions of this invention do not cover these RNAi agents to the extent that they are identical in both sequence and modifications.

Other particular specific embodiments include compositions comprising 1, 2, 3, 4, or more of these RNAi agents. Another embodiment is a composition comprising any single RNAi agent, along with any other RNAi agents which overlap it. Another embodiment comprises two, three, four or more HSF1 RNAi agents which do not overlap and thus target different parts of the RNA molecule. When two or more RNAi agents are used, they can be administered simultaneously or sequentially.

Another particular specific embodiment comprises an RNAi agent, wherein the RNAi agent comprises a sense strand comprising at least 15 contiguous nucleotides (identical in sequence) to the sense strand of any of the listed RNAi agents, and an antisense strand comprising at least 15 contiguous nucleotides (identical in sequence) to the antisense strand of the same RNAi agent. In another embodiment, the composition comprises one, two, three, four, or more such RNAi agents.

In one embodiment, the composition comprises an RNAi agent which comprises an antisense strand comprising at least 15 contiguous nucleotides differing by 0, 1, 2 or 3 mismatches from the antisense strand of a RNAi agent described herein.

In one embodiment, the composition comprises an RNAi agent which comprises an antisense strand comprising at least 15 contiguous nucleotides differing by 0, 1, 2 or 3 mismatches from the antisense strand of a RNAi agent described herein.

In another embodiment, the composition comprises an RNAi agent which comprises a sense strand comprising at least 15 contiguous nucleotides differing by 0, 1, 2, or 3 mismatches from the sense strand of one of the listed RNAi agents, and an antisense strand comprising at least 15 contiguous nucleotides differing by 0, 1, 2 or 3 mismatches from the antisense strand of the same RNAi agent.

A "mismatch" is defined herein as a difference between the base sequence or length when two sequences are maximally aligned and compared. As a non-limiting example, a mismatch is counted if a difference exists between the base at a particular location in one sequence and the base at the corresponding position in another sequence (e.g., between the sequence of a given RNAi agent and an RNAi agent listed herein). Thus, a mismatch is counted, for example, if a position in one sequence has a particular base (e.g., A), and the corresponding position on the other sequence has a different base (e.g., G, C or U). A mismatch is also counted, e.g., if a position in one sequence has a base (e.g., A), and the corresponding position on the other sequence has no base (e.g., that position is an abasic nucleotide which comprises a phosphate-sugar backbone but no base). A single-stranded nick in either sequence (or in the sense or antisense strand) is not counted as mismatch. Thus, as a non-limiting example, no mismatch would be counted if one sequence comprises the sequence A-G, but the other sequence comprises the sequence A-G with a single-stranded nick between the A and the G. A base modification is also not considered a mismatch. If one sequence comprises a C, and the other sequence comprises a modified C (e.g., with a 2'-modification) at the same position, no mismatch would be counted. Thus, modifications of a nucleotide other than replacement or alteration of the base would not constitute a mismatch. For example, no mismatch would occur between a nucleotide which is A, and a nucleotide which is A with a 5' modification (e.g., those illustrated in FIG. 1) and/or a 2'-modification. The key feature of a mismatch (base replacement) is that it would not be able to base-pair with the corresponding base on the opposite strand. In addition, terminal overhangs such as "UU" or "dTdT" are not counted when counting the number of mismatches; the terminal "UU" and "dTdT" overhangs are also not included when calculating "15 contiguous nucleotides."

In these embodiments, a mismatch is defined as a position wherein the base of one sequence does not match the base of the other sequence.

In another embodiment, the composition comprises 1, 2, 3, 4, or more such RNAi agents.

In another embodiment, the composition comprises an RNAi agent which comprises a sense strand comprising at least 15 contiguous nucleotides differing by 0, 1, 2 or 3 mismatches from the sense strand of one of the listed RNAi agents, and an antisense strand comprising at least 15 contiguous nucleotides differing by 0, 1, 2 or 3 mismatches from the antisense strand of the same RNAi agent.

Overlapping Groups of HSF1 siRNAs

In various embodiments, the disclosure relates to groups of RNAi agents with overlapping sequences. Thus, the disclosure encompasses groups of RNAi agents wherein each RNAi agent in the group overlaps with each other RNAi agent in the same group by at least 5, 6, 7, 8, 9, 10, 11, 12, 13, 14, 15, 16, 17, 18, 19 or more nucleotides. Particularly, in one embodiment, the overlap is at least 12 nt. Groups of sequences that overlap are shown in Table 3A.

Table 3A shows, for example, that AD-20594 and AD-20596 share the common technical feature of the sequence of ACGUCCCGGCCU [SEQ ID NO: 2097] in the sense strand, and the sequence of AGGCCGGGACGU [SEQ ID NO: 2646] in the antisense strand. Note of course that only a 12-nt portion of the overlap is shown; many groups of RNAi agents will overlap by more than 12 nt. The position within the gene is also indicated.

The disclosure thus encompasses various embodiments comprising groups of overlapping RNAi agents, for example (1) RNAi agents comprising the sequences of AD-20594 and AD-20596; (2) RNAi agents consisting of the sequences of AD-20594 and AD-20596; (3) RNAi agents comprising the sequences of AD-20594 and AD-20596; (4) RNAi agents comprising a sense strand and/or a antisense strand comprising a sequence of AD-20594 and AD-20596; (5) RNAi agents comprising a sense strand and/or a antisense strand comprising 15 contiguous nt with 0 to 3 mismatches from a sequence of AD-20594 and AD-20596; (6) RNAi agents comprising a sense strand comprising 15 contiguous nt with 0 to 3 mismatches from a sequence of AD-20594 and AD-20596; (7) RNAi agents comprising an antisense strand comprising 15 contiguous nt with 0 to 3 mismatches from a sequence of AD-20594 and AD-20596; etc. The disclosure also encompasses similar embodiments reflecting all the overlapping groups of RNAi agents as described in Table 3A.

Variants of RNAi agents (e.g., comprising different modifications, caps, etc.) are disclosed herein, e.g., in Tables 2, 3, 9A and 9B. In these texts and tables, for example, AD-20437 shares the same sequence as AD-20437.4, though the RNAi agents differ in their modifications, caps (e.g., 5' and/or 3' caps), etc. However, any overlapping group comprising a RNAi agent of a given sequence also comprises any other RNAi agent which has the same sequence, but different variations in modifications, caps, etc. Thus, any group of overlapping RNAi agents that includes AD-20437 also includes AD-20437.4 and other variants of the same sequence (e.g., with different modifications, caps, etc.). More embodiments are provided herein, and are included in the scope of each RNAi agents of the disclosure.

EXAMPLES

Example 1

Bioinformatics

Transcripts

Oligonucleotide design was carried out to identify siRNAs targeting the gene "heat shock transcription factor 1 (HSF1)" from human (NCBI symbol HSF1), the orthologous sequences from rhesus monkey (*Macaca mulatta*), cynomolgus monkey (*Macaca fascicularis*), and orangutan (*Pongo pygmaeus*). The design process used the HSF1 transcripts NM_005526.2 from human (NCBI GeneId 3297), ENSMMMUT00000020648 from rhesus (from Ensembl), internally cloned and sequenced cyno HSF1 sequences (e.g., SEQ ID NO: 2051), and ENSPPYT00000022122 from orangutan (from Ensembl). The design strategy was as follows: Begin with all perfect 19-mer human/cyno HSF1 matches. Next, expand this set with all perfect 19-mer human/orangutan/rhesus matches. Any 19-mers with mismatches to the partial cyno sequence available at the time of design were then excluded. Last, seven sequences were selected based on homology with the Novartis shRNA library. The resulting set of 512 19-mer sequences, all perfect matches to the human HSF1 gene, were then further sampled for synthesis and screening. These sequences are listed in Table 1. These sequences have not been modified.

The phrase "Position" denotes the starting position of the oligonucleotide (e.g., the 19-mer) on the transcript. This is measured in nucleotide coordinates, relative to beginning of the transcript.

TABLE 1

HSF1 19-mers

| Duplex Name | Position | SEQ ID NO | Sense 5'-3' unmodified | SEQ ID NO | Antisene 5'-3' unmodified |
|---|---|---|---|---|---|
| R0001 | 201 | 1 | GGGCCCAGCAACGUCCCGG | 513 | CCGGGACGUUGCUGGGCCC |
| R0002 | 202 | 2 | GGCCCAGCAACGUCCCGGC | 514 | GCCGGGACGUUGCUGGGCC |
| R0003 | 203 | 3 | GCCCAGCAACGUCCCGGCC | 515 | GGCCGGGACGUUGCUGGGC |
| R0004 | 204 | 4 | CCCAGCAACGUCCCGGCCU | 516 | AGGCCGGGACGUUGCUGGG |
| R0005 | 205 | 5 | CCAGCAACGUCCCGGCCUU | 517 | AAGGCCGGGACGUUGCUGG |
| R0006 | 206 | 6 | CAGCAACGUCCCGGCCUUC | 518 | GAAGGCCGGGACGUUGCUG |
| R0007 | 207 | 7 | AGCAACGUCCCGGCCUUCC | 519 | GGAAGGCCGGGACGUUGCU |
| R0008 | 208 | 8 | GCAACGUCCCGGCCUUCCU | 520 | AGGAAGGCCGGGACGUUGC |
| AD-20594 | 209 | 9 | CAACGUCCCGGCCUUCCUG | 521 | CAGGAAGGCCGGGACGUUG |
| AD-20595 | 210 | 10 | AACGUCCCGGCCUUCCUGA | 522 | UCAGGAAGGCCGGGACGUU |
| AD-20596 | 211 | 11 | ACGUCCCGGCCUUCCUGAC | 523 | GUCAGGAAGGCCGGGACGU |
| AD-20285 | 212 | 12 | CGUCCCGGCCUUCCUGACC | 524 | GGUCAGGAAGGCCGGGACG |
| AD-20286 | 213 | 13 | GUCCCGGCCUUCCUGACCA | 525 | UGGUCAGGAAGGCCGGGAC |
| AD-20287 | 216 | 14 | CCGGCCUUCCUGACCAAGC | 526 | GCUUGGUCAGGAAGGCCGG |
| AD-20288 | 217 | 15 | CGGCCUUCCUGACCAAGCU | 527 | AGCUUGGUCAGGAAGGCCG |
| AD-20289 | 218 | 16 | GGCCUUCCUGACCAAGCUG | 528 | CAGCUUGGUCAGGAAGGCC |
| AD-20290 | 219 | 17 | GCCUUCCUGACCAAGCUGU | 529 | ACAGCUUGGUCAGGAAGGC |
| AD-20291 | 220 | 18 | CCUUCCUGACCAAGCUGUG | 530 | CACAGCUUGGUCAGGAAGG |
| AD-20292 | 221 | 19 | CUUCCUGACCAAGCUGUGG | 531 | CCACAGCUUGGUCAGGAAG |
| AD-20293 | 222 | 20 | UUCCUGACCAAGCUGUGGA | 532 | UCCACAGCUUGGUCAGGAA |
| AD-20294 | 223 | 21 | UCCUGACCAAGCUGUGGAC | 533 | GUCCACAGCUUGGUCAGGA |
| AD-20295 | 224 | 22 | CCUGACCAAGCUGUGGACC | 534 | GGUCCACAGCUUGGUCAGG |
| AD-20296 | 225 | 23 | CUGACCAAGCUGUGGACCC | 535 | GGGUCCACAGCUUGGUCAG |
| AD-20297 | 226 | 24 | UGACCAAGCUGUGGACCCU | 536 | AGGGUCCACAGCUUGGUCA |
| AD-20298 | 227 | 25 | GACCAAGCUGUGGACCCUC | 537 | GAGGGUCCACAGCUUGGUC |
| AD-20299 | 228 | 26 | ACCAAGCUGUGGACCCUCG | 538 | CGAGGGUCCACAGCUUGGU |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20300 | 229 | 27 | CCAAGCUGUGGACCCUCGU | 539 | ACGAGGGUCCACAGCUUGG |
| AD-20301 | 230 | 28 | CAAGCUGUGGACCCUCGUG | 540 | CACGAGGGUCCACAGCUUG |
| AD-20302 | 231 | 29 | AAGCUGUGGACCCUCGUGA | 541 | UCACGAGGGUCCACAGCUU |
| AD-20303 | 232 | 30 | AGCUGUGGACCCUCGUGAG | 542 | CUCACGAGGGUCCACAGCU |
| AD-20304 | 233 | 31 | GCUGUGGACCCUCGUGAGC | 543 | GCUCACGAGGGUCCACAGC |
| AD-20305 | 234 | 32 | CUGUGGACCCUCGUGAGCG | 544 | CGCUCACGAGGGUCCACAG |
| AD-20306 | 235 | 33 | UGUGGACCCUCGUGAGCGA | 545 | UCGCUCACGAGGGUCCACA |
| AD-20307 | 236 | 34 | GUGGACCCUCGUGAGCGAC | 546 | GUCGCUCACGAGGGUCCAC |
| AD-20308 | 237 | 35 | UGGACCCUCGUGAGCGACC | 547 | GGUCGCUCACGAGGGUCCA |
| AD-20309 | 238 | 36 | GGACCCUCGUGAGCGACCC | 548 | GGGUCGCUCACGAGGGUCC |
| AD-20310 | 239 | 37 | GACCCUCGUGAGCGACCCG | 549 | CGGGUCGCUCACGAGGGUC |
| AD-20311 | 240 | 38 | ACCCUCGUGAGCGACCCGG | 550 | CCGGGUCGCUCACGAGGGU |
| AD-20312 | 241 | 39 | CCCUCGUGAGCGACCCGGA | 551 | UCCGGGUCGCUCACGAGGG |
| AD-20313 | 242 | 40 | CCUCGUGAGCGACCCGGAC | 552 | GUCCGGGUCGCUCACGAGG |
| AD-20314 | 243 | 41 | CUCGUGAGCGACCCGGACA | 553 | UGUCCGGGUCGCUCACGAG |
| AD-20315 | 244 | 42 | UCGUGAGCGACCCGGACAC | 554 | GUGUCCGGGUCGCUCACGA |
| AD-20316 | 245 | 43 | CGUGAGCGACCCGGACACC | 555 | GGUGUCCGGGUCGCUCACG |
| AD-20317 | 246 | 44 | GUGAGCGACCCGGACACCG | 556 | CGGUGUCCGGGUCGCUCAC |
| AD-20318 | 247 | 45 | UGAGCGACCCGGACACCGA | 557 | UCGGUGUCCGGGUCGCUCA |
| R0009 | 248 | 46 | GAGCGACCCGGACACCGAC | 558 | GUCGGUGUCCGGGUCGCUC |
| R0010 | 249 | 47 | AGCGACCCGGACACCGACG | 559 | CGUCGGUGUCCGGGUCGCU |
| R0011 | 250 | 48 | GCGACCCGGACACCGACGC | 560 | GCGUCGGUGUCCGGGUCGC |
| AD-20319 | 270 | 49 | CUCAUCUGCUGGAGCCCGA | 561 | UCGGGCUCCAGCAGAUGAG |
| AD-20320 | 271 | 50 | UCAUCUGCUGGAGCCCGAG | 562 | CUCGGGCUCCAGCAGAUGA |
| AD-20344 | 306 | 51 | GUGUUCGACCAGGGCCAGU | 563 | ACUGGCCCUGGUCGAACAC |
| AD-20345 | 307 | 52 | UGUUCGACCAGGGCCAGUU | 564 | AACUGGCCCUGGUCGAACA |
| R0103 | 308 | 53 | GUUCGACCAGGGCCAGUUU | 565 | AAACUGGCCCUGGUCGAAC |
| AD-20346 | 309 | 54 | UUCGACCAGGGCCAGUUUG | 566 | CAAACUGGCCCUGGUCGAA |
| AD-20347 | 310 | 55 | UCGACCAGGGCCAGUUUGC | 567 | GCAAACUGGCCCUGGUCGA |
| AD-20348 | 311 | 56 | CGACCAGGGCCAGUUUGCC | 568 | GGCAAACUGGCCCUGGUCG |
| AD-20349 | 312 | 57 | GACCAGGGCCAGUUUGCCA | 569 | UGGCAAACUGGCCCUGGUC |
| AD-20350 | 313 | 58 | ACCAGGGCCAGUUUGCCAA | 570 | UUGGCAAACUGGCCCUGGU |
| AD-20351 | 314 | 59 | CCAGGGCCAGUUUGCCAAG | 571 | CUUGGCAAACUGGCCCUGG |
| AD-20352 | 315 | 60 | CAGGGCCAGUUUGCCAAGG | 572 | CCUUGGCAAACUGGCCCUG |
| AD-20353 | 316 | 61 | AGGGCCAGUUUGCCAAGGA | 573 | UCCUUGGCAAACUGGCCCU |
| AD-20354 | 317 | 62 | GGGCCAGUUUGCCAAGGAG | 574 | CUCCUUGGCAAACUGGCCC |
| AD-20355 | 318 | 63 | GGCCAGUUUGCCAAGGAGG | 575 | CCUCCUUGGCAAACUGGCC |
| AD-20356 | 319 | 64 | GCCAGUUUGCCAAGGAGGU | 576 | ACCUCCUUGGCAAACUGGC |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20357 | 320 | 65 | CCAGUUUGCCAAGGAGGUG | 577 | CACCUCCUUGGCAAACUGG |
| AD-20358 | 321 | 66 | CAGUUUGCCAAGGAGGUGC | 578 | GCACCUCCUUGGCAAACUG |
| AD-20359 | 322 | 67 | AGUUUGCCAAGGAGGUGCU | 579 | AGCACCUCCUUGGCAAACU |
| AD-20360 | 323 | 68 | GUUUGCCAAGGAGGUGCUG | 580 | CAGCACCUCCUUGGCAAAC |
| AD-20361 | 324 | 69 | UUUGCCAAGGAGGUGCUGC | 581 | GCAGCACCUCCUUGGCAAA |
| AD-20362 | 325 | 70 | UUGCCAAGGAGGUGCUGCC | 582 | GGCAGCACCUCCUUGGCAA |
| AD-20363 | 326 | 71 | UGCCAAGGAGGUGCUGCCC | 583 | GGGCAGCACCUCCUUGGCA |
| AD-20364 | 327 | 72 | GCCAAGGAGGUGCUGCCCA | 584 | UGGGCAGCACCUCCUUGGC |
| AD-20365 | 328 | 73 | CCAAGGAGGUGCUGCCCAA | 585 | UUGGGCAGCACCUCCUUGG |
| AD-20366 | 329 | 74 | CAAGGAGGUGCUGCCCAAG | 586 | CUUGGGCAGCACCUCCUUG |
| AD-20367 | 330 | 75 | AAGGAGGUGCUGCCCAAGU | 587 | ACUUGGGCAGCACCUCCUU |
| AD-20368 | 331 | 76 | AGGAGGUGCUGCCCAAGUA | 588 | UACUUGGGCAGCACCUCCU |
| AD-20369 | 351 | 77 | UUCAAGCACAACAACAUGG | 589 | CCAUGUUGUUGUGCUUGAA |
| AD-20370 | 352 | 78 | UCAAGCACAACAACAUGGC | 590 | GCCAUGUUGUUGUGCUUGA |
| AD-20371 | 353 | 79 | CAAGCACAACAACAUGGCC | 591 | GGCCAUGUUGUUGUGCUUG |
| AD-20372 | 354 | 80 | AAGCACAACAACAUGGCCA | 592 | UGGCCAUGUUGUUGUGCUU |
| AD-20373 | 355 | 81 | AGCACAACAACAUGGCCAG | 593 | CUGGCCAUGUUGUUGUGCU |
| AD-20374 | 356 | 82 | GCACAACAACAUGGCCAGC | 594 | GCUGGCCAUGUUGUUGUGC |
| AD-20375 | 357 | 83 | CACAACAACAUGGCCAGCU | 595 | AGCUGGCCAUGUUGUUGUG |
| AD-20376 | 358 | 84 | ACAACAACAUGGCCAGCUU | 596 | AAGCUGGCCAUGUUGUUGU |
| AD-20378 | 360 | 85 | AACAACAUGGCCAGCUUCG | 597 | CGAAGCUGGCCAUGUUGUU |
| AD-20379 | 361 | 86 | ACAACAUGGCCAGCUUCGU | 598 | ACGAAGCUGGCCAUGUUGU |
| AD-20380 | 362 | 87 | CAACAUGGCCAGCUUCGUG | 599 | CACGAAGCUGGCCAUGUUG |
| AD-20381 | 363 | 88 | AACAUGGCCAGCUUCGUGC | 600 | GCACGAAGCUGGCCAUGUU |
| AD-20382 | 364 | 89 | ACAUGGCCAGCUUCGUGCG | 601 | CGCACGAAGCUGGCCAUGU |
| AD-20383 | 365 | 90 | CAUGGCCAGCUUCGUGCGG | 602 | CCGCACGAAGCUGGCCAUG |
| AD-20384 | 366 | 91 | AUGGCCAGCUUCGUGCGGC | 603 | GCCGCACGAAGCUGGCCAU |
| AD-20385 | 367 | 92 | UGGCCAGCUUCGUGCGGCA | 604 | UGCCGCACGAAGCUGGCCA |
| AD-20386 | 436 | 93 | UGGUCAAGCCAGAGAGAGA | 605 | UCUCUCUCUGGCUUGACCA |
| R0012 | 437 | 94 | GGUCAAGCCAGAGAGAGAC | 606 | GUCUCUCUCUGGCUUGACC |
| R0013 | 438 | 95 | GUCAAGCCAGAGAGAGACG | 607 | CGUCUCUCUCUGGCUUGAC |
| R0014 | 439 | 96 | UCAAGCCAGAGAGAGACGA | 608 | UCGUCUCUCUCUGGCUUGA |
| R0015 | 440 | 97 | CAAGCCAGAGAGAGACGAC | 609 | GUCGUCUCUCUCUGGCUUG |
| R0016 | 441 | 98 | AAGCCAGAGAGAGACGACA | 610 | UGUCGUCUCUCUCUGGCUU |
| R0017 | 442 | 99 | AGCCAGAGAGAGACGACAC | 611 | GUGUCGUCUCUCUCUGGCU |
| R0018 | 443 | 100 | GCCAGAGAGAGACGACACG | 612 | CGUGUCGUCUCUCUCUGGC |
| R0019 | 444 | 101 | CCAGAGAGAGACGACACGG | 613 | CCGUGUCGUCUCUCUCUGG |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| R0020 | 445 | 102 | CAGAGAGAGACGACACGGA | 614 | UCCGUGUCGUCUCUCUCUG |
| R0021 | 446 | 103 | AGAGAGAGACGACACGGAG | 615 | CUCCGUGUCGUCUCUCUCU |
| R0022 | 447 | 104 | GAGAGAGACGACACGGAGU | 616 | ACUCCGUGUCGUCUCUCUC |
| R0023 | 448 | 105 | AGAGAGACGACACGGAGUU | 617 | AACUCCGUGUCGUCUCUCU |
| R0024 | 449 | 106 | GAGAGACGACACGGAGUUC | 618 | GAACUCCGUGUCGUCUCUC |
| R0025 | 450 | 107 | AGAGACGACACGGAGUUCC | 619 | GGAACUCCGUGUCGUCUCU |
| R0026 | 451 | 108 | GAGACGACACGGAGUUCCA | 620 | UGGAACUCCGUGUCGUCUC |
| R0027 | 452 | 109 | AGACGACACGGAGUUCCAG | 621 | CUGGAACUCCGUGUCGUCU |
| R0028 | 453 | 110 | GACGACACGGAGUUCCAGC | 622 | GCUGGAACUCCGUGUCGUC |
| R0029 | 454 | 111 | ACGACACGGAGUUCCAGCA | 623 | UGCUGGAACUCCGUGUCGU |
| R0030 | 455 | 112 | CGACACGGAGUUCCAGCAC | 624 | GUGCUGGAACUCCGUGUCG |
| R0031 | 456 | 113 | GACACGGAGUUCCAGCACC | 625 | GGUGCUGGAACUCCGUGUC |
| R0032 | 457 | 114 | ACACGGAGUUCCAGCACCC | 626 | GGGUGCUGGAACUCCGUGU |
| AD-20387 | 489 | 115 | GGCCAGGAGCAGCUCCUUG | 627 | CAAGGAGCUGCUCCUGGCC |
| AD-20388 | 490 | 116 | GCCAGGAGCAGCUCCUUGA | 628 | UCAAGGAGCUGCUCCUGGC |
| AD-20389 | 491 | 117 | CCAGGAGCAGCUCCUUGAG | 629 | CUCAAGGAGCUGCUCCUGG |
| AD-20390 | 492 | 118 | CAGGAGCAGCUCCUUGAGA | 630 | UCUCAAGGAGCUGCUCCUG |
| AD-20391 | 493 | 119 | AGGAGCAGCUCCUUGAGAA | 631 | UUCUCAAGGAGCUGCUCCU |
| AD-20392 | 494 | 120 | GGAGCAGCUCCUUGAGAAC | 632 | GUUCUCAAGGAGCUGCUCC |
| AD-20393 | 495 | 121 | GAGCAGCUCCUUGAGAACA | 633 | UGUUCUCAAGGAGCUGCUC |
| AD-20394 | 496 | 122 | AGCAGCUCCUUGAGAACAU | 634 | AUGUUCUCAAGGAGCUGCU |
| AD-20395 | 497 | 123 | GCAGCUCCUUGAGAACAUC | 635 | GAUGUUCUCAAGGAGCUGC |
| AD-20396 | 498 | 124 | CAGCUCCUUGAGAACAUCA | 636 | UGAUGUUCUCAAGGAGCUG |
| AD-20397 | 499 | 125 | AGCUCCUUGAGAACAUCAA | 637 | UUGAUGUUCUCAAGGAGCU |
| AD-20398 | 500 | 126 | GCUCCUUGAGAACAUCAAG | 638 | CUUGAUGUUCUCAAGGAGC |
| AD-20399 | 501 | 127 | CUCCUUGAGAACAUCAAGA | 639 | UCUUGAUGUUCUCAAGGAG |
| AD-20400 | 502 | 128 | UCCUUGAGAACAUCAAGAG | 640 | CUCUUGAUGUUCUCAAGGA |
| AD-20401 | 503 | 129 | CCUUGAGAACAUCAAGAGG | 641 | CCUCUUGAUGUUCUCAAGG |
| AD-20402 | 504 | 130 | CUUGAGAACAUCAAGAGGA | 642 | UCCUCUUGAUGUUCUCAAG |
| AD-20403 | 505 | 131 | UUGAGAACAUCAAGAGGAA | 643 | UUCCUCUUGAUGUUCUCAA |
| AD-20404 | 506 | 132 | UGAGAACAUCAAGAGGAAA | 644 | UUUCCUCUUGAUGUUCUCA |
| R0033 | 507 | 133 | GAGAACAUCAAGAGGAAAG | 645 | CUUUCCUCUUGAUGUUCUC |
| R0034 | 508 | 134 | AGAACAUCAAGAGGAAAGU | 646 | ACUUUCCUCUUGAUGUUCU |
| AD-20405 | 509 | 135 | GAACAUCAAGAGGAAAGUG | 647 | CACUUUCCUCUUGAUGUUC |
| AD-20406 | 510 | 136 | AACAUCAAGAGGAAAGUGA | 648 | UCACUUUCCUGUUGAUGUU |
| AD-20407 | 511 | 137 | ACAUCAAGAGGAAAGUGAC | 649 | GUCACUUUCCUCUUGAUGU |
| AD-20408 | 512 | 138 | CAUCAAGAGGAAAGUGACC | 650 | GGUCACUUUCCUCUUGAUG |
| AD-20409 | 513 | 139 | AUCAAGAGGAAAGUGACCA | 651 | UGGUCACUUUCCUCUUGAU |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20410 | 514 | 140 | UCAAGAGGAAAGUGACCAG | 652 | CUGGUCACUUUCCUCUUGA |
| AD-20411 | 515 | 141 | CAAGAGGAAAGUGACCAGU | 653 | ACUGGUCACUUUCCUCUUG |
| AD-20412 | 516 | 142 | AAGAGGAAAGUGACCAGUG | 654 | CACUGGUCACUUUCCUCUU |
| AD-20413 | 517 | 2042 | AGAGGAAAGUGACCAGUGU | 2043 | ACACUGGUCACUUUCCUCU |
| AD-20414 | 518 | 143 | GAGGAAAGUGACCAGUGUG | 655 | CACACUGGUCACUUUCCUC |
| AD-20415 | 519 | 144 | AGGAAAGUGACCAGUGUGU | 656 | ACACACUGGUCACUUUCCU |
| AD-20416 | 520 | 145 | GGAAAGUGACCAGUGUGUC | 657 | GACACACUGGUCACUUUCC |
| AD-20417 | 521 | 146 | GAAAGUGACCAGUGUGUCC | 658 | GGACACACUGGUCACUUUC |
| AD-20418 | 522 | 147 | AAAGUGACCAGUGUGUCCA | 659 | UGGACACACUGGUCACUUU |
| AD-20419 | 523 | 148 | AAGUGACCAGUGUGUCCAC | 660 | GUGGACACACUGGUCACUU |
| AD-20420 | 524 | 149 | AGUGACCAGUGUGUCCACC | 661 | GGUGGACACACUGGUCACU |
| AD-20421 | 525 | 150 | GUGACCAGUGUGUCCACCC | 662 | GGGUGGACACACUGGUCAC |
| AD-20422 | 526 | 151 | UGACCAGUGUGUCCACCCU | 663 | AGGGUGGACACACUGGUCA |
| AD-20423 | 527 | 152 | GACCAGUGUGUCCACCCUG | 664 | CAGGGUGGACACACUGGUC |
| AD-20424 | 528 | 153 | ACCAGUGUGUCCACCCUGA | 665 | UCAGGGUGGACACACUGGU |
| AD-20425 | 529 | 154 | CCAGUGUGUCCACCCUGAA | 666 | UUCAGGGUGGACACACUGG |
| AD-20426 | 530 | 155 | CAGUGUGUCCACCCUGAAG | 667 | CUUCAGGGUGGACACACUG |
| AD-20427 | 531 | 156 | AGUGUGUCCACCCUGAAGA | 668 | UCUUCAGGGUGGACACACU |
| AD-20428 | 532 | 157 | GUGUGUCCACCCUGAAGAG | 669 | CUCUUCAGGGUGGACACAC |
| AD-20429 | 533 | 158 | UGUGUCCACCCUGAAGAGU | 670 | ACUCUUCAGGGUGGACACA |
| AD-20430 | 534 | 159 | GUGUCCACCCUGAAGAGUG | 671 | CACUCUUCAGGGUGGACAC |
| AD-20431 | 535 | 160 | UGUCCACCCUGAAGAGUGA | 672 | UCACUCUUCAGGGUGGACA |
| AD-20432 | 536 | 161 | GUCCACCCUGAAGAGUGAA | 673 | UUCACUCUUCAGGGUGGAC |
| AD-20433 | 537 | 162 | UCCACCCUGAAGAGUGAAG | 674 | CUUCACUCUUCAGGGUGGA |
| AD-20434 | 538 | 163 | CCACCCUGAAGAGUGAAGA | 675 | UCUUCACUCUUCAGGGUGG |
| AD-20435 | 539 | 164 | CACCCUGAAGAGUGAAGAC | 676 | GUCUUCACUCUUCAGGGUG |
| AD-20436 | 540 | 165 | ACCCUGAAGAGUGAAGACA | 677 | UGUCUUCACUCUUCAGGGU |
| AD-20437 | 541 | 166 | CCCUGAAGAGUGAAGACAU | 678 | AUGUCUUCACUCUUCAGGG |
| AD-20438 | 542 | 167 | CCUGAAGAGUGAAGACAUA | 679 | UAUGUCUUCACUCUUCAGG |
| AD-20439 | 543 | 168 | CUGAAGAGUGAAGACAUAA | 680 | UUAUGUCUUCACUCUUCAG |
| AD-20487 | 544 | 169 | UGAAGAGUGAAGACAUAAA | 681 | UUUAUGUCUUCACUCUUCA |
| AD-20488 | 545 | 170 | GAAGAGUGAAGACAUAAAG | 682 | CUUUAUGUCUUCACUCUUC |
| AD-20489 | 546 | 171 | AAGAGUGAAGACAUAAAGA | 683 | UCUUUAUGUCUUCACUCUU |
| AD-20490 | 547 | 172 | AGAGUGAAGACAUAAAGAU | 684 | AUCUUUAUGUCUUCACUCU |
| AD-20491 | 548 | 173 | GAGUGAAGACAUAAAGAUC | 685 | GAUCUUUAUGUCUUCACUC |
| AD-20492 | 549 | 174 | AGUGAAGACAUAAAGAUCC | 686 | GGAUCUUUAUGUCUUCACU |
| AD-20493 | 550 | 175 | GUGAAGACAUAAAGAUCCG | 687 | CGGAUCUUUAUGUCUUCAC |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20494 | 579 | 176 | GUCACCAAGCUGCUGACGG | 688 | CCGUCAGCAGCUUGGUGAC |
| AD-20495 | 580 | 177 | UCACCAAGCUGCUGACGGA | 689 | UCCGUCAGCAGCUUGGUGA |
| AD-20496 | 581 | 178 | CACCAAGCUGCUGACGGAC | 690 | GUCCGUCAGCAGCUUGGUG |
| AD-20497 | 582 | 179 | ACCAAGCUGCUGACGGACG | 691 | CGUCCGUCAGCAGCUUGGU |
| AD-20498 | 583 | 180 | CCAAGCUGCUGACGGACGU | 692 | ACGUCCGUCAGCAGCUUGG |
| AD-20499 | 584 | 181 | CAAGCUGCUGACGGACGUG | 693 | CACGUCCGUCAGCAGCUUG |
| AD-20500 | 585 | 182 | AAGCUGCUGACGGACGUGC | 694 | GCACGUCCGUCAGCAGCUU |
| AD-20501 | 586 | 183 | AGCUGCUGACGGACGUGCA | 695 | UGCACGUCCGUCAGCAGCU |
| AD-20502 | 587 | 184 | GCUGCUGACGGACGUGCAG | 696 | CUGCACGUCCGUCAGCAGC |
| AD-20503 | 588 | 185 | CUGCUGACGGACGUGCAGC | 697 | GCUGCACGUCCGUCAGCAG |
| AD-20504 | 589 | 186 | UGCUGACGGACGUGCAGCU | 698 | AGCUGCACGUCCGUCAGCA |
| AD-20505 | 590 | 187 | GCUGACGGACGUGCAGCUG | 699 | CAGCUGCACGUCCGUCAGC |
| AD-20506 | 591 | 188 | CUGACGGACGUGCAGCUGA | 700 | UCAGCUGCACGUCCGUCAG |
| AD-20507 | 592 | 189 | UGACGGACGUGCAGCUGAU | 701 | AUCAGCUGCACGUCCGUCA |
| AD-20508 | 593 | 190 | GACGGACGUGCAGCUGAUG | 702 | CAUCAGCUGCACGUCCGUC |
| AD-20509 | 594 | 191 | ACGGACGUGCAGCUGAUGA | 703 | UCAUCAGCUGCACGUCCGU |
| AD-20510 | 595 | 192 | CGGACGUGCAGCUGAUGAA | 704 | UUCAUCAGCUGCACGUCCG |
| AD-20511 | 596 | 193 | GGACGUGCAGCUGAUGAAG | 705 | CUUCAUCAGCUGCACGUCC |
| AD-20512 | 597 | 194 | GACGUGCAGCUGAUGAAGG | 706 | CCUUCAUCAGCUGCACGUC |
| AD-20513 | 598 | 195 | ACGUGCAGCUGAUGAAGGG | 707 | CCCUUCAUCAGCUGCACGU |
| AD-20514 | 660 | 196 | GAGAAUGAGGCUCUGUGGC | 708 | GCCACAGAGCCUCAUUCUC |
| AD-20515 | 661 | 197 | AGAAUGAGGCUCUGUGGCG | 709 | CGCCACAGAGCCUCAUUCU |
| AD-20516 | 662 | 198 | GAAUGAGGCUCUGUGGCGG | 710 | CCGCCACAGAGCCUCAUUC |
| AD-20517 | 663 | 199 | AAUGAGGCUCUGUGGCGGG | 711 | CCCGCCACAGAGCCUCAUU |
| AD-20518 | 664 | 200 | AUGAGGCUCUGUGGCGGGA | 712 | UCCCGCCACAGAGCCUCAU |
| AD-20519 | 665 | 201 | UGAGGCUCUGUGGCGGGAG | 713 | CUCCCGCCACAGAGCCUCA |
| AD-20520 | 666 | 202 | GAGGCUCUGUGGCGGGAGG | 714 | CCUCCCGCCACAGAGCCUC |
| AD-20521 | 667 | 203 | AGGCUCUGUGGCGGGAGGU | 715 | ACCUCCCGCCACAGAGCCU |
| AD-20522 | 668 | 204 | GGCUCUGUGGCGGGAGGUG | 716 | CACCUCCCGCCACAGAGCC |
| AD-20523 | 669 | 205 | GCUCUGUGGCGGGAGGUGG | 717 | CCACCUCCCGCCACAGAGC |
| AD-20524 | 670 | 206 | CUCUGUGGCGGGAGGUGGC | 718 | GCCACCUCCCGCCACAGAG |
| AD-20525 | 671 | 207 | UCUGUGGCGGGAGGUGGCC | 719 | GGCACCUCCCGCCACAGA |
| AD-20526 | 672 | 208 | CUGUGGCGGGAGGUGGCCA | 720 | UGGCCACCUCCCGCCACAG |
| AD-20527 | 673 | 209 | UGUGGCGGGAGGUGGCCAG | 721 | CUGGCCACCUCCCGCCACA |
| AD-20528 | 674 | 210 | GUGGCGGGAGGUGGCCAGC | 722 | GCUGGCCACCUCCCGCCAC |
| AD-20529 | 675 | 211 | UGGCGGGAGGUGGCCAGCC | 723 | GGCUGGCCACCUCCCGCCA |
| AD-20530 | 676 | 212 | GGCGGGAGGUGGCCAGCCU | 724 | AGGCUGGCCACCUCCCGCC |
| AD-20531 | 677 | 213 | GCGGGAGGUGGCCAGCCUU | 725 | AAGGCUGGCCACCUCCCGC |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20532 | 678 | 214 | CGGGAGGUGGCCAGCCUUC | 726 | GAAGGCUGGCCACCUCCCG |
| AD-20533 | 679 | 215 | GGGAGGUGGCCAGCCUUCG | 727 | CGAAGGCUGGCCACCUCCC |
| AD-20534 | 680 | 216 | GGAGGUGGCCAGCCUUCGG | 728 | CCGAAGGCUGGCCACCUCC |
| AD-20535 | 681 | 217 | GAGGUGGCCAGCCUUCGGC | 729 | GCCGAAGGCUGGCCACCUC |
| AD-20536 | 682 | 218 | AGGUGGCCAGCCUUCGGCA | 730 | UGCCGAAGGCUGGCCACCU |
| AD-20537 | 683 | 219 | GGUGGCCAGCCUUCGGCAG | 731 | CUGCCGAAGGCUGGCCACC |
| AD-20538 | 684 | 220 | GUGGCCAGCCUUCGGCAGA | 732 | UCUGCCGAAGGCUGGCCAC |
| AD-20539 | 685 | 221 | UGGCCAGCCUUCGGCAGAA | 733 | UUCUGCCGAAGGCUGGCCA |
| R0035 | 686 | 222 | GGCCAGCCUUCGGCAGAAG | 734 | CUUCUGCCGAAGGCUGGCC |
| R0036 | 687 | 223 | GCCAGCCUUCGGCAGAAGC | 735 | GCUUCUGCCGAAGGCUGGC |
| R0037 | 688 | 224 | CCAGCCUUCGGCAGAAGCA | 736 | UGCUUCUGCCGAAGGCUGG |
| R0038 | 689 | 225 | CAGCCUUCGGCAGAAGCAU | 737 | AUGCUUCUGCCGAAGGCUG |
| AD-20540 | 690 | 226 | AGCCUUCGGCAGAAGCAUG | 738 | CAUGCUUCUGCCGAAGGCU |
| AD-20541 | 691 | 227 | GCCUUCGGCAGAAGCAUGC | 739 | GCAUGCUUCUGCCGAAGGC |
| AD-20542 | 692 | 228 | CCUUCGGCAGAAGCAUGCC | 740 | GGCAUGCUUCUGCCGAAGG |
| AD-20543 | 693 | 229 | CUUCGGCAGAAGCAUGCCC | 741 | GGGCAUGCUUCUGCCGAAG |
| AD-20544 | 694 | 230 | UUCGGCAGAAGCAUGCCCA | 742 | UGGGCAUGCUUCUGCCGAA |
| AD-20545 | 695 | 231 | UCGGCAGAAGCAUGCCCAG | 743 | CUGGGCAUGCUUCUGCCGA |
| AD-20546 | 696 | 232 | CGGCAGAAGCAUGCCCAGC | 744 | GCUGGGCAUGCUUCUGCCG |
| AD-20547 | 697 | 233 | GGCAGAAGCAUGCCCAGCA | 745 | UGCUGGGCAUGCUUCUGCC |
| AD-20548 | 698 | 234 | GCAGAAGCAUGCCCAGCAA | 746 | UUGCUGGGCAUGCUUCUGC |
| AD-20549 | 699 | 235 | CAGAAGCAUGCCCAGCAAC | 747 | GUUGCUGGGCAUGCUUCUG |
| AD-20550 | 700 | 236 | AGAAGCAUGCCCAGCAACA | 748 | UGUUGCUGGGCAUGCUUCU |
| AD-20551 | 701 | 237 | GAAGCAUGCCCAGCAACAG | 749 | CUGUUGCUGGGCAUGCUUC |
| AD-20552 | 702 | 238 | AAGCAUGCCCAGCAACAGA | 750 | UCUGUUGCUGGGCAUGCUU |
| AD-20553 | 703 | 239 | AGCAUGCCCAGCAACAGAA | 751 | UUCUGUUGCUGGGCAUGCU |
| AD-20554 | 704 | 240 | GCAUGCCCAGCAACAGAAA | 752 | UUUCUGUUGCUGGGCAUGC |
| AD-20555 | 705 | 241 | CAUGCCCAGCAACAGAAAG | 753 | CUUUCUGUUGCUGGGCAUG |
| AD-20556 | 706 | 242 | AUGCCCAGCAACAGAAAGU | 754 | ACUUUCUGUUGCUGGGCAU |
| AD-20557 | 707 | 243 | UGCCCAGCAACAGAAAGUC | 755 | GACUUUCUGUUGCUGGGCA |
| R0039 | 708 | 244 | GCCCAGCAACAGAAAGUCG | 756 | CGACUUUCUGUUGCUGGGC |
| R0040 | 709 | 245 | CCCAGCAACAGAAAGUCGU | 757 | ACGACUUUCUGUUGCUGGG |
| R0041 | 710 | 246 | CCAGCAACAGAAAGUCGUC | 758 | GACGACUUUCUGUUGCUGG |
| R0042 | 711 | 247 | CAGCAACAGAAAGUCGUCA | 759 | UGACGACUUUCUGUUGCUG |
| R0043 | 712 | 248 | AGCAACAGAAAGUCGUCAA | 760 | UUGACGACUUUCUGUUGCU |
| R0044 | 713 | 249 | GCAACAGAAAGUCGUCAAC | 761 | GUUGACGACUUUCUGUUGC |
| R0045 | 714 | 250 | CAACAGAAAGUCGUCAACA | 762 | UGUUGACGACUUUCUGUUG |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| R0046 | 715 | 251 | AACAGAAAGUCGUCAACAA | 763 | UUGUUGACGACUUUCUGUU |
| R0047 | 716 | 252 | ACAGAAAGUCGUCAACAAG | 764 | CUUGUUGACGACUUUCUGU |
| R0048 | 717 | 253 | CAGAAAGUCGUCAACAAGC | 765 | GCUUGUUGACGACUUUCUG |
| R0049 | 718 | 254 | AGAAAGUCGUCAACAAGCU | 766 | AGCUUGUUGACGACUUUCU |
| R0050 | 719 | 255 | GAAAGUCGUCAACAAGCUC | 767 | GAGCUUGUUGACGACUUUC |
| R0051 | 720 | 256 | AAAGUCGUCAACAAGCUCA | 768 | UGAGCUUGUUGACGACUUU |
| R0052 | 721 | 257 | AAGUCGUCAACAAGCUCAU | 769 | AUGAGCUUGUUGACGACUU |
| R0053 | 722 | 258 | AGUCGUCAACAAGCUCAUU | 770 | AAUGAGCUUGUUGACGACU |
| R0054 | 723 | 259 | GUCGUCAACAAGCUCAUUC | 771 | GAAUGAGCUUGUUGACGAC |
| R0055 | 724 | 260 | UCGUCAACAAGCUCAUUCA | 772 | UGAAUGAGCUUGUUGACGA |
| R0056 | 725 | 261 | CGUCAACAAGCUCAUUCAG | 773 | CUGAAUGAGCUUGUUGACG |
| R0057 | 726 | 262 | GUCAACAAGCUCAUUCAGU | 774 | ACUGAAUGAGCUUGUUGAC |
| R0058 | 727 | 263 | UCAACAAGCUCAUUCAGUU | 775 | AACUGAAUGAGCUUGUUGA |
| R0059 | 728 | 264 | CAACAAGCUCAUUCAGUUC | 776 | GAACUGAAUGAGCUUGUUG |
| R0060 | 729 | 265 | AACAAGCUCAUUCAGUUCC | 777 | GGAACUGAAUGAGCUUGUU |
| R0061 | 730 | 266 | ACAAGCUCAUUCAGUUCCU | 778 | AGGAACUGAAUGAGCUUGU |
| AD-20558 | 731 | 267 | CAAGCUCAUUCAGUUCCUG | 779 | CAGGAACUGAAUGAGCUUG |
| AD-20559 | 732 | 268 | AAGCUCAUUCAGUUCCUGA | 780 | UCAGGAACUGAAUGAGCUU |
| AD-20560 | 733 | 269 | AGCUCAUUCAGUUCCUGAU | 781 | AUCAGGAACUGAAUGAGCU |
| AD-20561 | 734 | 270 | GCUCAUUCAGUUCCUGAUC | 782 | GAUCAGGAACUGAAUGAGC |
| AD-20562 | 735 | 271 | CUCAUUCAGUUCCUGAUCU | 783 | AGAUCAGGAACUGAAUGAG |
| AD-20563 | 736 | 272 | UCAUUCAGUUCCUGAUCUC | 784 | GAGAUCAGGAACUGAAUGA |
| AD-20564 | 737 | 273 | CAUUCAGUUCCUGAUCUCA | 785 | UGAGAUCAGGAACUGAAUG |
| AD-20565 | 738 | 274 | AUUCAGUUCCUGAUCUCAC | 786 | GUGAGAUCAGGAACUGAAU |
| AD-20566 | 739 | 275 | UUCAGUUCCUGAUCUCACU | 787 | AGUGAGAUCAGGAACUGAA |
| AD-20567 | 740 | 276 | UCAGUUCCUGAUCUCACUG | 788 | CAGUGAGAUCAGGAACUGA |
| AD-20568 | 741 | 277 | CAGUUCCUGAUCUCACUGG | 789 | CCAGUGAGAUCAGGAACUG |
| AD-20569 | 742 | 278 | AGUUCCUGAUCUCACUGGU | 790 | ACCAGUGAGAUCAGGAACU |
| AD-20571 | 744 | 279 | UUCCUGAUCUCACUGGUGC | 791 | GCACCAGUGAGAUCAGGAA |
| AD-20572 | 745 | 280 | UCCUGAUCUCACUGGUGCA | 792 | UGCACCAGUGAGAUCAGGA |
| AD-20573 | 746 | 281 | CCUGAUCUCACUGGUGCAG | 793 | CUGCACCAGUGAGAUCAGG |
| AD-20574 | 747 | 2044 | CUGAUCUCACUGGUGCAGU | 2045 | ACUGCACCAGUGAGAUCAG |
| AD-20575 | 748 | 282 | UGAUCUCACUGGUGCAGUC | 794 | GACUGCACCAGUGAGAUCA |
| AD-20576 | 749 | 283 | GAUCUCACUGGUGCAGUCA | 795 | UGACUGCACCAGUGAGAUC |
| AD-20577 | 750 | 284 | AUCUCACUGGUGCAGUCAA | 796 | UUGACUGCACCAGUGAGAU |
| AD-20578 | 751 | 285 | UCUCACUGGUGCAGUCAAA | 797 | UUUGACUGCACCAGUGAGA |
| AD-20579 | 752 | 286 | CUCACUGGUGCAGUCAAAC | 798 | GUUUGACUGCACCAGUGAG |
| AD-20581 | 754 | 287 | CACUGGUGCAGUCAAACCG | 799 | CGGUUUGACUGCACCAGUG |

TABLE 1-continued

HSF1 19-mers

| Duplex Name | Position | SEQ ID NO | Sense 5'-3' unmodified | SEQ ID NO | Antisense 5'-3' unmodified |
|---|---|---|---|---|---|
| AD-20582 | 755 | 288 | ACUGGUGCAGUCAAACCGG | 800 | CCGGUUUGACUGCACCAGU |
| AD-20625 | 756 | 289 | CUGGUGCAGUCAAACCGGA | 801 | UCCGGUUUGACUGCACCAG |
| AD-20626 | 757 | 290 | UGGUGCAGUCAAACCGGAU | 802 | AUCCGGUUUGACUGCACCA |
| AD-20627 | 758 | 291 | GGUGCAGUCAAACCGGAUC | 803 | GAUCCGGUUUGACUGCACC |
| AD-20628 | 759 | 292 | GUGCAGUCAAACCGGAUCC | 804 | GGAUCCGGUUUGACUGCAC |
| AD-20629 | 760 | 293 | UGCAGUCAAACCGGAUCCU | 805 | AGGAUCCGGUUUGACUGCA |
| AD-20630 | 761 | 294 | GCAGUCAAACCGGAUCCUG | 806 | CAGGAUCCGGUUUGACUGC |
| AD-20631 | 762 | 295 | CAGUCAAACCGGAUCCUGG | 807 | CCAGGAUCCGGUUUGACUG |
| AD-20632 | 763 | 296 | AGUCAAACCGGAUCCUGGG | 808 | CCCAGGAUCCGGUUUGACU |
| AD-20633 | 781 | 297 | GGGUGAAGAGAAAGAUCCC | 809 | GGGAUCUUUCUCUUCACCC |
| AD-20634 | 799 | 298 | CCCUGAUGCUGAACGACAG | 810 | CUGUCGUUCAGCAUCAGGG |
| AD-20635 | 800 | 299 | CCUGAUGCUGAACGACAGU | 811 | ACUGUCGUUCAGCAUCAGG |
| AD-20636 | 801 | 300 | CUGAUGCUGAACGACAGUG | 812 | CACUGUCGUUCAGCAUCAG |
| AD-20637 | 802 | 301 | UGAUGCUGAACGACAGUGG | 813 | CCACUGUCGUUCAGCAUCA |
| AD-20638 | 803 | 302 | GAUGCUGAACGACAGUGGC | 814 | GCCACUGUCGUUCAGCAUC |
| AD-20639 | 804 | 303 | AUGCUGAACGACAGUGGCU | 815 | AGCCACUGUCGUUCAGCAU |
| AD-20640 | 805 | 304 | UGCUGAACGACAGUGGCUC | 816 | GAGCCACUGUCGUUCAGCA |
| AD-20641 | 806 | 305 | GCUGAACGACAGUGGCUCA | 817 | UGAGCCACUGUCGUUCAGC |
| AD-20642 | 807 | 306 | CUGAACGACAGUGGCUCAG | 818 | CUGAGCCACUGUCGUUCAG |
| AD-20643 | 808 | 307 | UGAACGACAGUGGCUCAGC | 819 | GCUGAGCCACUGUCGUUCA |
| AD-20644 | 809 | 308 | GAACGACAGUGGCUCAGCA | 820 | UGCUGAGCCACUGUCGUUC |
| AD-20645 | 810 | 309 | AACGACAGUGGCUCAGCAC | 821 | GUGCUGAGCCACUGUCGUU |
| AD-20646 | 811 | 310 | ACGACAGUGGCUCAGCACA | 822 | UGUGCUGAGCCACUGUCGU |
| AD-20647 | 812 | 311 | CGACAGUGGCUCAGCACAU | 823 | AUGUGCUGAGCCACUGUCG |
| AD-20648 | 813 | 312 | GACAGUGGCUCAGCACAUU | 824 | AAUGUGCUGAGCCACUGUC |
| AD-20649 | 814 | 313 | ACAGUGGCUCAGCACAUUC | 825 | GAAUGUGCUGAGCCACUGU |
| AD-20650 | 815 | 314 | CAGUGGCUCAGCACAUUCC | 826 | GGAAUGUGCUGAGCCACUG |
| AD-20651 | 816 | 315 | AGUGGCUCAGCACAUUCCA | 827 | UGGAAUGUGCUGAGCCACU |
| AD-20652 | 817 | 316 | GUGGCUCAGCACAUUCCAU | 828 | AUGGAAUGUGCUGAGCCAC |
| AD-20653 | 818 | 317 | UGGCUCAGCACAUUCCAUG | 829 | CAUGGAAUGUGCUGAGCCA |
| AD-20654 | 819 | 318 | GGCUCAGCACAUUCCAUGC | 830 | GCAUGGAAUGUGCUGAGCC |
| AD-20655 | 820 | 319 | GCUCAGCACAUUCCAUGCC | 831 | GGCAUGGAAUGUGCUGAGC |
| AD-20656 | 821 | 320 | CUCAGCACAUUCCAUGCCC | 832 | GGGCAUGGAAUGUGCUGAG |
| AD-20657 | 822 | 321 | UCAGCACAUUCCAUGCCCA | 833 | UGGGCAUGGAAUGUGCUGA |
| AD-20658 | 823 | 322 | CAGCACAUUCCAUGCCCAA | 834 | UUGGGCAUGGAAUGUGCUG |
| AD-20659 | 824 | 323 | AGCACAUUCCAUGCCCAAG | 835 | CUUGGGCAUGGAAUGUGCU |
| AD-20660 | 825 | 324 | GCACAUUCCAUGCCCAAGU | 836 | ACUUGGGCAUGGAAUGUGC |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20661 | 826 | 325 | CACAUUCCAUGCCCAAGUA | 837 | UACUUGGGCAUGGAAUGUG |
| AD-20284 | 827 | 326 | ACAUUCCAUGCCCAAGUAU | 838 | AUACUUGGGCAUGGAAUGU |
| AD-20662 | 847 | 327 | GCCGGCAGUUCUCCCUGGA | 839 | UCCAGGGAGAACUGCCGGC |
| AD-20868 | 848 | 328 | CCGGCAGUUCUCCCUGGAG | 840 | CUCCAGGGAGAACUGCCGG |
| AD-20663 | 849 | 329 | CGGCAGUUCUCCCUGGAGC | 841 | GCUCCAGGGAGAACUGCCG |
| AD-20664 | 850 | 330 | GGCAGUUCUCCCUGGAGCA | 842 | UGCUCCAGGGAGAACUGCC |
| AD-20665 | 851 | 331 | GCAGUUCUCCCUGGAGCAC | 843 | GUGCUCCAGGGAGAACUGC |
| AD-20666 | 852 | 332 | CAGUUCUCCCUGGAGCACG | 844 | CGUGCUCCAGGGAGAACUG |
| AD-20667 | 853 | 333 | AGUUCUCCCUGGAGCACGU | 845 | ACGUGCUCCAGGGAGAACU |
| AD-20668 | 854 | 334 | GUUCUCCCUGGAGCACGUC | 846 | GACGUGCUCCAGGGAGAAC |
| AD-20669 | 855 | 335 | UUCUCCCUGGAGCACGUCC | 847 | GGACGUGCUCCAGGGAGAA |
| AD-20670 | 856 | 336 | UCUCCCUGGAGCACGUCCA | 848 | UGGACGUGCUCCAGGGAGA |
| AD-20671 | 857 | 337 | CUCCCUGGAGCACGUCCAC | 849 | GUGGACGUGCUCCAGGGAG |
| AD-20672 | 858 | 338 | UCCCUGGAGCACGUCCACG | 850 | CGUGGACGUGCUCCAGGGA |
| AD-20673 | 859 | 339 | CCCUGGAGCACGUCCACGG | 851 | CCGUGGACGUGCUCCAGGG |
| AD-20674 | 860 | 340 | CCUGGAGCACGUCCACGGC | 852 | GCCGUGGACGUGCUCCAGG |
| AD-20675 | 861 | 341 | CUGGAGCACGUCCACGGCU | 853 | AGCCGUGGACGUGCUCCAG |
| AD-20676 | 862 | 342 | UGGAGCACGUCCACGGCUC | 854 | GAGCCGUGGACGUGCUCCA |
| R0062 | 863 | 343 | GGAGCACGUCCACGGCUCG | 855 | CGAGCCGUGGACGUGCUCC |
| R0063 | 864 | 344 | GAGCACGUCCACGGCUCGG | 856 | CCGAGCCGUGGACGUGCUC |
| R0064 | 865 | 345 | AGCACGUCCACGGCUCGGG | 857 | CCCGAGCCGUGGACGUGCU |
| R0065 | 866 | 346 | GCACGUCCACGGCUCGGGC | 858 | GCCCGAGCCGUGGACGUGC |
| R0066 | 867 | 347 | CACGUCCACGGCUCGGGCC | 859 | GGCCCGAGCCGUGGACGUG |
| R0067 | 868 | 348 | ACGUCCACGGCUCGGGCCC | 860 | GGGCCCGAGCCGUGGACGU |
| AD-20677 | 915 | 349 | AGCUCCAGCCUCUACGCCC | 861 | GGGCGUAGAGGCUGGAGCU |
| R0068 | 954 | 350 | GGACCCAUCAUCUCCGACA | 862 | UGUCGGAGAUGAUGGGUCC |
| R0069 | 955 | 351 | GACCCAUCAUCUCCGACAU | 863 | AUGUCGGAGAUGAUGGGUC |
| R0070 | 956 | 352 | ACCCAUCAUCUCCGACAUC | 864 | GAUGUCGGAGAUGAUGGGU |
| R0071 | 957 | 353 | CCCAUCAUCUCCGACAUCA | 865 | UGAUGUCGGAGAUGAUGGG |
| R0072 | 958 | 354 | CCAUCAUCUCCGACAUCAC | 866 | GUGAUGUCGGAGAUGAUGG |
| R0073 | 959 | 355 | CAUCAUCUCCGACAUCACC | 867 | GGUGAUGUCGGAGAUGAUG |
| R0074 | 960 | 356 | AUCAUCUCCGACAUCACCG | 868 | CGGUGAUGUCGGAGAUGAU |
| R0075 | 961 | 357 | UCAUCUCCGACAUCACCGA | 869 | UCGGUGAUGUCGGAGAUGA |
| R0076 | 962 | 358 | CAUCUCCGACAUCACCGAG | 870 | CUCGGUGAUGUCGGAGAUG |
| R0077 | 963 | 359 | AUCUCCGACAUCACCGAGC | 871 | GCUCGGUGAUGUCGGAGAU |
| R0078 | 964 | 360 | UCUCCGACAUCACCGAGCU | 872 | AGCUCGGUGAUGUCGGAGA |
| AD-20678 | 965 | 361 | CUCCGACAUCACCGAGCUG | 873 | CAGCUCGGUGAUGUCGGAG |
| AD-20679 | 966 | 362 | UCCGACAUCACCGAGCUGG | 874 | CCAGCUCGGUGAUGUCGGA |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20680 | 967 | 363 | CCGACAUCACCGAGCUGGC | 875 | GCCAGCUCGGUGAUGUCGG |
| AD-20681 | 968 | 364 | CGACAUCACCGAGCUGGCU | 876 | AGCCAGCUCGGUGAUGUCG |
| AD-20682 | 969 | 365 | GACAUCACCGAGCUGGCUC | 877 | GAGCCAGCUCGGUGAUGUC |
| AD-20683 | 970 | 366 | ACAUCACCGAGCUGGCUCC | 878 | GGAGCCAGCUCGGUGAUGU |
| AD-20684 | 971 | 367 | CAUCACCGAGCUGGCUCCU | 879 | AGGAGCCAGCUCGGUGAUG |
| AD-20685 | 972 | 368 | AUCACCGAGCUGGCUCCUG | 880 | CAGGAGCCAGCUCGGUGAU |
| AD-20686 | 973 | 369 | UCACCGAGCUGGCUCCUGC | 881 | GCAGGAGCCAGCUCGGUGA |
| AD-20687 | 974 | 370 | CACCGAGCUGGCUCCUGCC | 882 | GGCAGGAGCCAGCUCGGUG |
| AD-20688 | 975 | 371 | ACCGAGCUGGCUCCUGCCA | 883 | UGGCAGGAGCCAGCUCGGU |
| AD-20689 | 976 | 372 | CCGAGCUGGCUCCUGCCAG | 884 | CUGGCAGGAGCCAGCUCGG |
| AD-20690 | 977 | 373 | CGAGCUGGCUCCUGCCAGC | 885 | GCUGGCAGGAGCCAGCUCG |
| AD-20691 | 978 | 374 | GAGCUGGCUCCUGCCAGCC | 886 | GGCUGGCAGGAGCCAGCUC |
| AD-20692 | 979 | 375 | AGCUGGCUCCUGCCAGCCC | 887 | GGGCUGGCAGGAGCCAGCU |
| AD-20693 | 1011 | 376 | GGCGGGAGCAUAGACGAGA | 888 | UCUCGUCUAUGCUCCCGCC |
| AD-20694 | 1012 | 377 | GCGGGAGCAUAGACGAGAG | 889 | CUCUCGUCUAUGCUCCCGC |
| AD-20695 | 1013 | 378 | CGGGAGCAUAGACGAGAGG | 890 | CCUCUCGUCUAUGCUCCCG |
| AD-20696 | 1014 | 379 | GGGAGCAUAGACGAGAGGC | 891 | GCCUCUCGUCUAUGCUCCC |
| AD-20697 | 1015 | 380 | GGAGCAUAGACGAGAGGCC | 892 | GGCCUCUCGUCUAUGCUCC |
| AD-20698 | 1016 | 381 | GAGCAUAGACGAGAGGCCC | 893 | GGGCCUCUCGUCUAUGCUC |
| AD-20699 | 1048 | 382 | CCCUGGUGCGUGUCAAGGA | 894 | UCCUUGACACGCACCAGGG |
| AD-20700 | 1049 | 383 | CCUGGUGCGUGUCAAGGAG | 895 | CUCCUUGACACGCACCAGG |
| AD-20701 | 1050 | 384 | CUGGUGCGUGUCAAGGAGG | 896 | CCUCCUUGACACGCACCAG |
| AD-20702 | 1051 | 385 | UGGUGCGUGUCAAGGAGGA | 897 | UCCUCCUUGACACGCACCA |
| AD-20869 | 1052 | 386 | GGUGCGUGUCAAGGAGGAG | 898 | CUCCUCCUUGACACGCACC |
| AD-20703 | 1053 | 387 | GUGCGUGUCAAGGAGGAGC | 899 | GCUCCUCCUUGACACGCAC |
| AD-20704 | 1054 | 388 | UGCGUGUCAAGGAGGAGCC | 900 | GGCUCCUCCUUGACACGCA |
| AD-20705 | 1055 | 389 | GCGUGUCAAGGAGGAGCCC | 901 | GGGCUCCUCCUUGACACGC |
| R0079 | 1074 | 390 | CCCAGCCCGCCUCAGAGCC | 902 | GGCUCUGAGGCGGGCUGGG |
| R0080 | 1075 | 391 | CCAGCCCGCCUCAGAGCCC | 903 | GGGCUCUGAGGCGGGCUGG |
| AD-20706 | 1329 | 392 | CACUUGGAUGCUAUGGACU | 904 | AGUCCAUAGCAUCCAAGUG |
| AD-20707 | 1330 | 393 | ACUUGGAUGCUAUGGACUC | 905 | GAGUCCAUAGCAUCCAAGU |
| AD-20709 | 1332 | 394 | UUGGAUGCUAUGGACUCCA | 906 | UGGAGUCCAUAGCAUCCAA |
| AD-20710 | 1333 | 395 | UGGAUGCUAUGGACUCCAA | 907 | UUGGAGUCCAUAGCAUCCA |
| AD-20711 | 1334 | 396 | GGAUGCUAUGGACUCCAAC | 908 | GUUGGAGUCCAUAGCAUCC |
| AD-20712 | 1335 | 397 | GAUGCUAUGGACUCCAACC | 909 | GGUUGGAGUCCAUAGCAUC |
| AD-20713 | 1336 | 398 | AUGCUAUGGACUCCAACCU | 910 | AGGUUGGAGUCCAUAGCAU |
| AD-20714 | 1337 | 399 | UGCUAUGGACUCCAACCUG | 911 | CAGGUUGGAGUCCAUAGCA |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20715 | 1338 | 400 | GCUAUGGACUCCAACCUGG | 912 | CCAGGUUGGAGUCCAUAGC |
| AD-20716 | 1339 | 401 | CUAUGGACUCCAACCUGGA | 913 | UCCAGGUUGGAGUCCAUAG |
| AD-20717 | 1359 | 402 | AACCUGCAGACCAUGCUGA | 914 | UCAGCAUGGUCUGCAGGUU |
| AD-20718 | 1360 | 403 | ACCUGCAGACCAUGCUGAG | 915 | CUCAGCAUGGUCUGCAGGU |
| AD-20719 | 1361 | 404 | CCUGCAGACCAUGCUGAGC | 916 | GCUCAGCAUGGUCUGCAGG |
| AD-20720 | 1362 | 405 | CUGCAGACCAUGCUGAGCA | 917 | UGCUCAGCAUGGUCUGCAG |
| AD-20721 | 1363 | 406 | UGCAGACCAUGCUGAGCAG | 918 | CUGCUCAGCAUGGUCUGCA |
| AD-20722 | 1364 | 407 | GCAGACCAUGCUGAGCAGC | 919 | GCUGCUCAGCAUGGUCUGC |
| AD-20723 | 1365 | 408 | CAGACCAUGCUGAGCAGCC | 920 | GGCUGCUCAGCAUGGUCUG |
| AD-20724 | 1366 | 409 | AGACCAUGCUGAGCAGCCA | 921 | UGGCUGCUCAGCAUGGUCU |
| AD-20725 | 1367 | 410 | GACCAUGCUGAGCAGCCAC | 922 | GUGGCUGCUCAGCAUGGUC |
| AD-20726 | 1368 | 411 | ACCAUGCUGAGCAGCCACG | 923 | CGUGGCUGCUCAGCAUGGU |
| AD-20727 | 1369 | 412 | CCAUGCUGAGCAGCCACGG | 924 | CCGUGGCUGCUCAGCAUGG |
| AD-20728 | 1370 | 413 | CAUGCUGAGCAGCCACGGC | 925 | GCCGUGGCUGCUCAGCAUG |
| AD-20729 | 1371 | 414 | AUGCUGAGCAGCCACGGCU | 926 | AGCCGUGGCUGCUCAGCAU |
| AD-20730 | 1372 | 415 | UGCUGAGCAGCCACGGCUU | 927 | AAGCCGUGGCUGCUCAGCA |
| AD-20731 | 1373 | 416 | GCUGAGCAGCCACGGCUUC | 928 | GAAGCCGUGGCUGCUCAGC |
| AD-20732 | 1374 | 417 | CUGAGCAGCCACGGCUUCA | 929 | UGAAGCCGUGGCUGCUCAG |
| AD-20733 | 1375 | 418 | UGAGCAGCCACGGCUUCAG | 930 | CUGAAGCCGUGGCUGCUCA |
| R0081 | 1376 | 419 | GAGCAGCCACGGCUUCAGC | 931 | GCUGAAGCCGUGGCUGCUC |
| R0082 | 1377 | 420 | AGCAGCCACGGCUUCAGCG | 932 | CGCUGAAGCCGUGGCUGCU |
| R0083 | 1378 | 421 | GCAGCCACGGCUUCAGCGU | 933 | ACGCUGAAGCCGUGGCUGC |
| AD-20734 | 1379 | 422 | CAGCCACGGCUUCAGCGUG | 934 | CACGCUGAAGCCGUGGCUG |
| AD-20735 | 1380 | 423 | AGCCACGGCUUCAGCGUGG | 935 | CCACGCUGAAGCCGUGGCU |
| AD-20736 | 1381 | 424 | GCCACGGCUUCAGCGUGGA | 936 | UCCACGCUGAAGCCGUGGC |
| AD-20737 | 1382 | 425 | CCACGGCUUCAGCGUGGAC | 937 | GUCCACGCUGAAGCCGUGG |
| AD-20738 | 1383 | 426 | CACGGCUUCAGCGUGGACA | 938 | UGUCCACGCUGAAGCCGUG |
| AD-20739 | 1384 | 427 | ACGGCUUCAGCGUGGACAC | 939 | GUGUCCACGCUGAAGCCGU |
| AD-20740 | 1385 | 428 | CGGCUUCAGCGUGGACACC | 940 | GGUGUCCACGCUGAAGCCG |
| AD-20741 | 1386 | 429 | GGCUUCAGCGUGGACACCA | 941 | UGGUGUCCACGCUGAAGCC |
| AD-20742 | 1387 | 430 | GCUUCAGCGUGGACACCAG | 942 | CUGGUGUCCACGCUGAAGC |
| AD-20743 | 1407 | 431 | GCCCUGCUGGACCUGUUCA | 943 | UGAACAGGUCCAGCAGGGC |
| AD-20744 | 1408 | 432 | CCCUGCUGGACCUGUUCAG | 944 | CUGAACAGGUCCAGCAGGG |
| AD-20745 | 1409 | 433 | CCUGCUGGACCUGUUCAGC | 945 | GCUGAACAGGUCCAGCAGG |
| AD-20746 | 1410 | 434 | CUGCUGGACCUGUUCAGCC | 946 | GGCUGAACAGGUCCAGCAG |
| AD-20747 | 1411 | 435 | UGCUGGACCUGUUCAGCCC | 947 | GGGCUGAACAGGUCCAGCA |
| AD-20748 | 1428 | 436 | CCCUCGGUGACCGUGCCCG | 948 | CGGGCACGGUCACCGAGGG |
| AD-20749 | 1429 | 437 | CCUCGGUGACCGUGCCCGA | 949 | UCGGGCACGGUCACCGAGG |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20750 | 1430 | 438 | CUCGGUGACCGUGCCCGAC | 950 | GUCGGGCACGGUCACCGAG |
| AD-20751 | 1431 | 439 | UCGGUGACCGUGCCCGACA | 951 | UGUCGGGCACGGUCACCGA |
| AD-20752 | 1432 | 440 | CGGUGACCGUGCCCGACAU | 952 | AUGUCGGGCACGGUCACCG |
| AD-20753 | 1433 | 441 | GGUGACCGUGCCCGACAUG | 953 | CAUGUCGGGCACGGUCACC |
| AD-20754 | 1434 | 442 | GUGACCGUGCCCGACAUGA | 954 | UCAUGUCGGGCACGGUCAC |
| AD-20755 | 1435 | 443 | UGACCGUGCCCGACAUGAG | 955 | CUCAUGUCGGGCACGGUCA |
| AD-20756 | 1436 | 444 | GACCGUGCCCGACAUGAGC | 956 | GCUCAUGUCGGGCACGGUC |
| AD-20757 | 1437 | 445 | ACCGUGCCCGACAUGAGCC | 957 | GGCUCAUGUCGGGCACGGU |
| AD-20758 | 1438 | 446 | CCGUGCCCGACAUGAGCCU | 958 | AGGCUCAUGUCGGGCACGG |
| AD-20759 | 1439 | 447 | CGUGCCCGACAUGAGCCUG | 959 | CAGGCUCAUGUCGGGCACG |
| AD-20760 | 1440 | 448 | GUGCCCGACAUGAGCCUGC | 960 | GCAGGCUCAUGUCGGGCAC |
| AD-20761 | 1441 | 449 | UGCCCGACAUGAGCCUGCC | 961 | GGCAGGCUCAUGUCGGGCA |
| AD-20762 | 1442 | 450 | GCCCGACAUGAGCCUGCCU | 962 | AGGCAGGCUCAUGUCGGGC |
| AD-20763 | 1443 | 451 | CCCGACAUGAGCCUGCCUG | 963 | CAGGCAGGCUCAUGUCGGG |
| AD-20764 | 1444 | 452 | CCGACAUGAGCCUGCCUGA | 964 | UCAGGCAGGCUCAUGUCGG |
| AD-20765 | 1445 | 453 | CGACAUGAGCCUGCCUGAC | 965 | GUCAGGCAGGCUCAUGUCG |
| AD-20766 | 1446 | 454 | GACAUGAGCCUGCCUGACC | 966 | GGUCAGGCAGGCUCAUGUC |
| AD-20767 | 1447 | 455 | ACAUGAGCCUGCCUGACCU | 967 | AGGUCAGGCAGGCUCAUGU |
| AD-20768 | 1448 | 456 | CAUGAGCCUGCCUGACCUU | 968 | AAGGUCAGGCAGGCUCAUG |
| AD-20769 | 1449 | 457 | AUGAGCCUGCCUGACCUUG | 969 | CAAGGUCAGGCAGGCUCAU |
| AD-20770 | 1450 | 458 | UGAGCCUGCCUGACCUUGA | 970 | UCAAGGUCAGGCAGGCUCA |
| AD-20771 | 1451 | 459 | GAGCCUGCCUGACCUUGAC | 971 | GUCAAGGUCAGGCAGGCUC |
| AD-20772 | 1452 | 460 | AGCCUGCCUGACCUUGACA | 972 | UGUCAAGGUCAGGCAGGCU |
| AD-20773 | 1453 | 461 | GCCUGCCUGACCUUGACAG | 973 | CUGUCAAGGUCAGGCAGGC |
| AD-20774 | 1454 | 462 | CCUGCCUGACCUUGACAGC | 974 | GCUGUCAAGGUCAGGCAGG |
| AD-20775 | 1455 | 463 | CUGCCUGACCUUGACAGCA | 975 | UGCUGUCAAGGUCAGGCAG |
| AD-20776 | 1456 | 464 | UGCCUGACCUUGACAGCAG | 976 | CUGCUGUCAAGGUCAGGCA |
| AD-20777 | 1457 | 465 | GCCUGACCUUGACAGCAGC | 977 | GCUGCUGUCAAGGUCAGGC |
| AD-20778 | 1458 | 466 | CCUGACCUUGACAGCAGCC | 978 | GGCUGCUGUCAAGGUCAGG |
| AD-20779 | 1459 | 467 | CUGACCUUGACAGCAGCCU | 979 | AGGCUGCUGUCAAGGUCAG |
| AD-20780 | 1460 | 468 | UGACCUUGACAGCAGCCUG | 980 | CAGGCUGCUGUCAAGGUCA |
| AD-20781 | 1461 | 469 | GACCUUGACAGCAGCCUGG | 981 | CCAGGCUGCUGUCAAGGUC |
| AD-20782 | 1462 | 470 | ACCUUGACAGCAGCCUGGC | 982 | GCCAGGCUGCUGUCAAGGU |
| AD-20783 | 1482 | 471 | AGUAUCCAAGAGCUCCUGU | 983 | ACAGGAGCUCUUGGAUACU |
| AD-20784 | 1483 | 472 | GUAUCCAAGAGCUCCUGUC | 984 | GACAGGAGCUCUUGGAUAC |
| AD-20785 | 1484 | 473 | UAUCCAAGAGCUCCUGUCU | 985 | AGACAGGAGCUCUUGGAUA |
| AD-20786 | 1485 | 474 | AUCCAAGAGCUCCUGUCUC | 986 | GAGACAGGAGCUCUUGGAU |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20787 | 1486 | 475 | UCCAAGAGCUCCUGUCUCC | 987 | GGAGACAGGAGCUCUUGGA |
| AD-20788 | 1487 | 476 | CCAAGAGCUCCUGUCUCCC | 988 | GGGAGACAGGAGCUCUUGG |
| R0084 | 1533 | 477 | GAGAACAGCAGCCCGGAUU | 989 | AAUCCGGGCUGCUGUUCUC |
| R0085 | 1534 | 478 | AGAACAGCAGCCCGGAUUC | 990 | GAAUCCGGGCUGCUGUUCU |
| R0086 | 1535 | 479 | GAACAGCAGCCCGGAUUCA | 991 | UGAAUCCGGGCUGCUGUUC |
| R0087 | 1536 | 480 | AACAGCAGCCCGGAUUCAG | 992 | CUGAAUCCGGGCUGCUGUU |
| R0088 | 1537 | 481 | ACAGCAGCCCGGAUUCAGG | 993 | CCUGAAUCCGGGCUGCUGU |
| R0089 | 1538 | 482 | CAGCAGCCCGGAUUCAGGG | 994 | CCCUGAAUCCGGGCUGCUG |
| R0090 | 1539 | 483 | AGCAGCCCGGAUUCAGGGA | 995 | UCCCUGAAUCCGGGCUGCU |
| R0091 | 1540 | 484 | GCAGCCCGGAUUCAGGGAA | 996 | UUCCCUGAAUCCGGGCUGC |
| R0092 | 1541 | 485 | CAGCCCGGAUUCAGGGAAG | 997 | CUUCCCUGAAUCCGGGCUG |
| R0093 | 1542 | 486 | AGCCCGGAUUCAGGGAAGC | 998 | GCUUCCCUGAAUCCGGGCU |
| R0094 | 1543 | 487 | GCCCGGAUUCAGGGAAGCA | 999 | UGCUUCCCUGAAUCCGGGC |
| R0095 | 1544 | 488 | CCCGGAUUCAGGGAAGCAG | 1000 | CUGCUUCCCUGAAUCCGGG |
| R0096 | 1545 | 489 | CCGGAUUCAGGGAAGCAGC | 1001 | GCUGCUUCCCUGAAUCCGG |
| R0097 | 1546 | 490 | CGGAUUCAGGGAAGCAGCU | 1002 | AGCUGCUUCCCUGAAUCCG |
| AD-20789 | 1547 | 491 | GGAUUCAGGGAAGCAGCUG | 1003 | CAGCUGCUUCCCUGAAUCC |
| AD-20790 | 1548 | 492 | GAUUCAGGGAAGCAGCUGG | 1004 | CCAGCUGCUUCCCUGAAUC |
| AD-20791 | 1549 | 493 | AUUCAGGGAAGCAGCUGGU | 1005 | ACCAGCUGCUUCCCUGAAU |
| AD-20792 | 1602 | 494 | CCCGGCUCCGUGGACACCG | 1006 | CGGUGUCCACGGAGCCGGG |
| AD-20793 | 1603 | 495 | CCGGCUCCGUGGACACCGG | 1007 | CCGGUGUCCACGGAGCCGG |
| AD-20794 | 1604 | 496 | CGGCUCCGUGGACACCGGG | 1008 | CCCGGUGUCCACGGAGCCG |
| AD-20795 | 1605 | 497 | GGCUCCGUGGACACCGGGA | 1009 | UCCCGGUGUCCACGGAGCC |
| AD-20796 | 1606 | 498 | GCUCCGUGGACACCGGGAG | 1010 | CUCCCGGUGUCCACGGAGC |
| AD-20870 | 1607 | 499 | CUCCGUGGACACCGGGAGC | 1011 | GCUCCCGGUGUCCACGGAG |
| AD-20871 | 1608 | 500 | UCCGUGGACACCGGGAGCA | 1012 | UGCUCCCGGUGUCCACGGA |
| AD-20872 | 1633 | 501 | UGCCGGUGCUGUUUGAGCU | 1013 | AGCUCAAACAGCACCGGCA |
| AD-20797 | 1634 | 502 | GCCGGUGCUGUUUGAGCUG | 1014 | CAGCUCAAACAGCACCGGC |
| AD-20798 | 1635 | 503 | CCGGUGCUGUUUGAGCUGG | 1015 | CCAGCUCAAACAGCACCGG |
| AD-20799 | 1636 | 504 | CGGUGCUGUUUGAGCUGGG | 1016 | CCCAGCUCAAACAGCACCG |
| AD-20873 | 1698 | 505 | CCCACCAUCUCCCUGCUGA | 1017 | UCAGCAGGGAGAUGGUGGG |
| AD-20800 | 1699 | 506 | CCACCAUCUCCCUGCUGAC | 1018 | GUCAGCAGGGAGAUGGUGG |
| AD-20801 | 1700 | 507 | CACCAUCUCCCUGCUGACA | 1019 | UGUCAGCAGGGAGAUGGUG |
| R0098 | 1725 | 508 | GAGCCUCCCAAAGCCAAGG | 1020 | CCUUGGCUUUGGGAGGCUC |
| R0099 | 1726 | 509 | AGCCUCCCAAAGCCAAGGA | 1021 | UCCUUGGCUUUGGGAGGCU |
| R0100 | 1727 | 510 | GCCUCCCAAAGCCAAGGAC | 1022 | GUCCUUGGCUUUGGGAGGC |
| R0101 | 1728 | 511 | CCUCCCAAAGCCAAGGACC | 1023 | GGUCCUUGGCUUUGGGAGG |
| R0102 | 1729 | 512 | CUCCCAAAGCCAAGGACCC | 1024 | GGGUCCUUGGCUUUGGGAG |

TABLE 1-continued

HSF1 19-mers

| Duplex Name | Position | SEQ ID NO | Sense 5'-3' unmodified | SEQ ID NO | Antisene 5'-3' unmodified |
|---|---|---|---|---|---|
| AD-20278 | | 2053 | GCAGGUUGUUCAUAGUCAG | 2064 | CUGACUAUGAACAACCUGC |
| AD-20279 | | 2054 | CAGGUUGUUCAUAGUCAGA | 2065 | UCUGACUAUGAACAACCUG |
| AD-20280 | | 2055 | AGGUUGUUCAUAGUCAGAA | 2066 | UUCUGACUAUGAACAACCU |
| AD-20281 | | 2056 | GCCCAAGUACUUCAAGCAC | 2067 | GUGCUUGAAGUACUUGGGC |
| AD-20282 | | 2057 | CCCAAGUACUUCAAGCACA | 2068 | UGUGCUUGAAGUACUUGGG |
| AD-20283 | | 2058 | CCAAGUACUUCAAGCACAA | 2069 | UUGUGCUUGAAGUACUUGG |
| AD-20377 | | 2059 | CAACAACAUGGCCAGCUUC | 2070 | GAAGCUGGCCAUGUUGUUG |
| AD-20570 | | 2060 | GUUCCUGAUCUCACUGGUG | 2071 | CACCAGUGAGAUCAGGAAC |
| AD-20580 | | 2061 | UCACUGGUGCAGUCAAACC | 2072 | GGUUUGACUGCACCAGUGA |
| AD-20597 | | 2062 | UUGGUCAGGAAGGCCGGGA | 2073 | UCCCGGCCUUCCUGACCAA |
| AD-20598 | | 2063 | CCCGGCCUUCCUGACCAAG | 2074 | CUUGGUCAGGAAGGCCGGG |

Modifications of the sequences in Table 1 are easily conceived by one of skill in the art. Example and non-limiting modifications of these sequences were conceived. These are listed in Tables 2 and 3. Additional modifications are contemplated.

For the modified sequences listed in Tables 2 and 3, some modifications were placed at sites predicted to be sensitive to endonucleases. Some modifications were designed to eliminate an immune response to the siRNA while preserving activity. In general, the sense strand was heavily modified, and the antisense strand lightly modified. Some modifications serve more than one purpose. Table 2 lists RNAi agents prepared with these modified sequences.

Subsequent to screening, a full-length HSF1 gene sequence from cynomolgus monkey was produced (see above), and used to assess identity of human/cyno 19-mer sequences. Of 406 19-mers screened for single dose efficacy in WI38 and Hela cells, 375 are perfect matches between human and cyno (e.g., zero mismatches).

TABLE 2

HSF1 RNAi agents (with modified sequences)

| Duplex Name | Position | SEQ ID NO | Sense 5'-3'modified | SEQ ID NO | Antisense 5'-3' modified |
|---|---|---|---|---|---|
| AD-20594 | 209 | 1033 | cAAcGucccGGccuuccuGdTdT | 1545 | cAGGAAGGCCGGGACGUUGdTdT |
| AD-20595 | 210 | 1034 | UcAGGAAGGCCGGGACGUUdTdT | 1546 | AAcGucccGGccuuccuGAdTdT |
| AD-20596 | 211 | 1035 | AcGucccGGccuuccuGAcdTdT | 1547 | GUcAGGAAGGCCGGGACGUdTdT |
| AD-20285 | 212 | 1036 | cGucccGGccuuccuGAccdTdT | 1548 | GGUcAGGAAGGCCGGGACGdTdT |
| AD-20286 | 213 | 1037 | GucccGGccuuccuGAccAdTdT | 1549 | UGGUcAGGAAGGCCGGGACdTdT |
| AD-20287 | 216 | 1038 | ccGGccuuccuGAccAAGcdTdT | 1550 | GCUUGGUcAGGAAGGCCGGdTdT |
| AD-20288 | 217 | 1039 | cGGccuuccuGAccAAGcudTdT | 1551 | AGCUUGGUcAGGAAGGCCGdTdT |
| AD-20289 | 218 | 1040 | GGccuuccuGAccAAGcuGdTdT | 1552 | cAGCUUGGUcAGGAAGGCCdTdT |
| AD-20290 | 219 | 1041 | GccuuccuGAccAAGcuGudTdT | 1553 | AcAGCUUGGUcAGGAAGGCdTdT |
| AD-20291 | 220 | 1042 | ccuuccuGAccAAGcuGuGdTdT | 1554 | cAcAGCUUGGUcAGGAAGGdTdT |
| AD-20292 | 221 | 1043 | cuuccuGAccAAGcuGuGGdTdT | 1555 | CcAcAGCUUGGUcAGGAAGdTdT |
| AD-20293 | 222 | 1044 | uuccuGAccAAGcuGuGGAdTdT | 1556 | UCcAcAGCUUGGUcAGGAAdTdT |
| AD-20294 | 223 | 1045 | uccuGAccAAGcuGuGGAcdTdT | 1557 | GUCcAcAGCUUGGUcAGGAdTdT |
| AD-20295 | 224 | 1046 | ccuGAccAAGcuGuGGAccdTdT | 1558 | GGUCcAcAGCUUGGUcAGGdTdT |
| AD-20296 | 225 | 1047 | cuGAccAAGcuGuGGAcccdTdT | 1559 | GGGUCcAcAGCUUGGUcAGdTdT |

TABLE 2-continued

HSF1 RNAi agents (with modified sequences)

| Duplex Name | Position | SEQ ID NO | Sense 5'-3' modified | SEQ ID NO | Antisense 5'-3' modified |
|---|---|---|---|---|---|
| AD-20297 | 226 | 1048 | uGAccAAGcuGuGGAcccudTdT | 1560 | AGGGUCcAcAGCUUGGUcAdTdT |
| AD-20298 | 227 | 1049 | GAccAAGcuGuGGAccucdTdT | 1561 | GAGGGUCcAcAGCUUGGUCdTdT |
| AD-20299 | 228 | 1050 | AccAAGcuGuGGAccucGdTdT | 1562 | CGAGGGUCcAcAGCUUGGUdTdT |
| AD-20300 | 229 | 1051 | ccAAGcuGuGGAccucGudTdT | 1563 | ACGAGGGUCcAcAGCUUGGdTdT |
| AD-20301 | 230 | 1052 | cAAGcuGuGGAccucGuGdTdT | 1564 | cACGAGGGUCcAcAGCUUGdTdT |
| AD-20302 | 231 | 1053 | AAGcuGuGGAccucGuGAdTdT | 1565 | UcACGAGGGUCcAcAGCUUdTdT |
| AD-20303 | 232 | 1054 | AGcuGuGGAccucGuGAGdTdT | 1566 | CUcACGAGGGUCcAcAGCUdTdT |
| AD-20304 | 233 | 1055 | GcuGuGGAccucGuGAGcdTdT | 1567 | GCUcACGAGGGUCcAcAGCdTdT |
| AD-20305 | 234 | 1056 | cuGuGGAccucGuGAGcGdTdT | 1568 | CGCUcACGAGGGUCcAcAGdTdT |
| AD-20306 | 235 | 1057 | uGuGGAccucGuGAGcGAdTdT | 1569 | UCGCUcACGAGGGUCcAcAdTdT |
| AD-20307 | 236 | 1058 | GuGGAccucGuGAGcGAcdTdT | 1570 | GUCGCUcACGAGGGUCcACdTdT |
| AD-20308 | 237 | 1059 | uGGAccucGuGAGcGAccdTdT | 1571 | GGUCGCUcACGAGGGUCcAdTdT |
| AD-20309 | 238 | 1060 | GGAccucGuGAGcGAcccdTdT | 1572 | GGGUCGCUcACGAGGGUCCdTdT |
| AD-20310 | 239 | 1061 | GAcccucGuGAGcGAcccGdTdT | 1573 | CGGGUCGCUcACGAGGGUCdTdT |
| AD-20311 | 240 | 1062 | AcccucGuGAGcGAcccGGdTdT | 1574 | CCGGGUCGCUcACGAGGGUdTdT |
| AD-20312 | 241 | 1063 | cccucGuGAGcGAcccGGAdTdT | 1575 | UCCGGGUCGCUcACGAGGGdTdT |
| AD-20313 | 242 | 1064 | ccucGuGAGcGAcccGGAcdTdT | 1576 | GUCCGGGUCGCUcACGAGGdTdT |
| AD-20314 | 243 | 1065 | cucGuGAGcGAcccGGAcAdTdT | 1577 | UGUCCGGGUCGCUcACGAGdTdT |
| AD-20315 | 244 | 1066 | ucGuGAGcGAcccGGAcAcdTdT | 1578 | GUGUCCGGGUCGCUcACGAdTdT |
| AD-20316 | 245 | 1067 | cGuGAGcGAcccGGAcAccdTdT | 1579 | GGUGUCCGGGUCGCUcACGdTdT |
| AD-20317 | 246 | 1068 | GuGAGcGAcccGGAcAccGdTdT | 1580 | CGGUGUCCGGGUCGCUcACdTdT |
| AD-20318 | 247 | 1069 | uGAGcGAcccGGAcAccGAdTdT | 1581 | UCGGUGUCCGGGUCGCUcAdTdT |
| AD-20319 | 270 | 1073 | cucAucuGcuGGAGcccGAdTdT | 1585 | UCGGGCUCcAGcAGAUGAGdTdT |
| AD-20320 | 271 | 1074 | ucAucuGcuGGAGcccGAGdTdT | 1586 | CUCGGGCUCcAGcAGAUGAdTdT |
| AD-20344 | 306 | 1075 | GuGuucGAccAGGGccAGudTdT | 1587 | ACUGGCCCUGGUCGAAcACdTdT |
| AD-20345 | 307 | 1076 | uGuucGAccAGGGccAGuudTdT | 1588 | AACUGGCCCUGGUCGAAcAdTdT |
| AD-20346 | 309 | 1078 | uucGAccAGGGccAGuuuGdTdT | 1590 | cAAACUGGCCCUGGUCGAAdTdT |
| AD-20347 | 310 | 1079 | ucGAccAGGGccAGuuuGcdTdT | 1591 | GcAAACUGGCCCUGGUCGAdTdT |
| AD-20348 | 311 | 1080 | cGAccAGGGccAGuuuGccdTdT | 1592 | GGcAAACUGGCCCUGGUCGdTdT |
| AD-20349 | 312 | 1081 | GAccAGGGccAGuuuGccAdTdT | 1593 | UGGcAAACUGGCCCUGGUCdTdT |
| AD-20350 | 313 | 1082 | AccAGGGccAGuuuGccAAdTdT | 1594 | UUGGcAAACUGGCCCUGGUdTdT |
| AD-20351 | 314 | 1083 | ccAGGGccAGuuuGccAAGdTdT | 1595 | CUUGGcAAACUGGCCCUGGdTdT |
| AD-20352 | 315 | 1084 | cAGGGccAGuuuGccAAGGdTdT | 1596 | CCUUGGcAAACUGGCCCUGdTdT |
| AD-20353 | 316 | 1085 | AGGGccAGuuuGccAAGGAdTdT | 1597 | UCCUUGGcAAACUGGCCCUdTdT |
| AD-20354 | 317 | 1086 | GGGccAGuuuGccAAGGAGdTdT | 1598 | CUCCUUGGcAAACUGGCCCdTdT |
| AD-20355 | 318 | 1087 | GGccAGuuuGccAAGGAGGdTdT | 1599 | CCUCCUUGGcAAACUGGCCdTdT |
| AD-20356 | 319 | 1088 | GccAGuuuGccAAGGAGGudTdT | 1600 | ACCUCCUUGGcAAACUGGCdTdT |
| AD-20357 | 320 | 1089 | ccAGuuuGccAAGGAGGuGdTdT | 1601 | cACCUCCUUGGcAAACUGGdTdT |

TABLE 2-continued

HSF1 RNAi agents (with modified sequences)

| Duplex Name | Position | SEQ ID NO | Sense 5'-3'modified | SEQ ID NO | Antisense 5'-3' modified |
|---|---|---|---|---|---|
| AD-20358 | 321 | 1090 | cAGuuuGccAAGGAGGuGcdTdT | 1602 | GcACCUCCUUGGcAAACUGdTdT |
| AD-20359 | 322 | 1091 | AGuuuGccAAGGAGGuGcudTdT | 1603 | AGcACCUCCUUGGcAAACUdTdT |
| AD-20360 | 323 | 1092 | GuuuGccAAGGAGGuGcuGdTdT | 1604 | cAGcACCUCCUUGGcAAACdTdT |
| AD-20361 | 324 | 1093 | uuuGccAAGGAGGuGcuGcdTdT | 1605 | GcAGcACCUCCUUGGcAAAdTdT |
| AD-20362 | 325 | 1094 | uuGccAAGGAGGuGcuGccdTdT | 1606 | GGcAGcACCUCCUUGGcAAdTdT |
| AD-20363 | 326 | 1095 | uGccAAGGAGGuGcuGcccdTdT | 1607 | GGGcAGcACCUCCUUGGcAdTdT |
| AD-20364 | 327 | 1096 | GccAAGGAGGuGcuGcccAdTdT | 1608 | UGGGcAGcACCUCCUUGGcdTdT |
| AD-20365 | 328 | 1097 | ccAAGGAGGuGcuGcccAAdTdT | 1609 | UUGGGcAGcACCUCCUUGGdTdT |
| AD-20366 | 329 | 1098 | cAAGGAGGuGcuGcccAAGdTdT | 1610 | CUUGGGcAGcACCUCCUUGdTdT |
| AD-20367 | 330 | 1099 | AAGGAGGuGcuGcccAAGudTdT | 1611 | ACUUGGGcAGcACCUCCUUdTdT |
| AD-20368 | 331 | 1100 | AGGAGGuGcuGcccAAGuAdTdT | 1612 | uACUUGGGcAGcACCUCCUdTdT |
| AD-20369 | 351 | 1101 | uucAAGcAcAAcAAcAuGGdTdT | 1613 | CcAUGUUGUUGUGCUUGAAdTdT |
| AD-20370 | 352 | 1102 | ucAAGcAcAAcAAcAuGGcdTdT | 1614 | GCcAUGUUGUUGUGCUUGAdTdT |
| AD-20371 | 353 | 1103 | cAAGcAcAAcAAcAuGGccdTdT | 1615 | GGCcAUGUUGUUGUGCUUGdTdT |
| AD-20372 | 354 | 1104 | AAGcAcAAcAAcAuGGccAdTdT | 1616 | UGGCcAUGUUGUUGUGCUUdTdT |
| AD-20373 | 355 | 1105 | AGcAcAAcAAcAuGGccAGdTdT | 1617 | CUGGCcAUGUUGUUGUGCUdTdT |
| AD-20374 | 356 | 1106 | GcAcAAcAAcAuGGccAGcdTdT | 1618 | GCUGGCcAUGUUGUUGUGCdTdT |
| AD-20375 | 357 | 1107 | cAcAAcAAcAuGGccAGcudTdT | 1619 | AGCUGGCcAUGUUGUUGUGdTdT |
| AD-20376 | 358 | 1108 | AcAAcAAcAuGGccAGcuudTdT | 1620 | AAGCUGGCcAUGUUGUUGUdTdT |
| AD-20378 | 360 | 1109 | AAcAAcAuGGccAGcuucGdTdT | 1621 | CGAAGCUGGCcAUGUUGUUdTdT |
| AD-20379 | 361 | 1110 | AcAAcAuGGccAGcuucGudTdT | 1622 | ACGAAGCUGGCcAUGUUGUdTdT |
| AD-20380 | 362 | 1111 | cAAcAuGGccAGcuucGuGdTdT | 1623 | cACGAAGCUGGCcAUGUUGdTdT |
| AD-20381 | 363 | 1112 | AAcAuGGccAGcuucGuGcdTdT | 1624 | GcACGAAGCUGGCcAUGUUdTdT |
| AD-20382 | 364 | 1113 | AcAuGGccAGcuucGuGcGdTdT | 1625 | CGcACGAAGCUGGCcAUGUdTdT |
| AD-20383 | 365 | 1114 | cAuGGccAGcuucGuGcGGdTdT | 1626 | CCGcACGAAGCUGGCcAUGdTdT |
| AD-20384 | 366 | 1115 | AuGGccAGcuucGuGcGGcdTdT | 1627 | GCCGcACGAAGCUGGCcAUdTdT |
| AD-20385 | 367 | 1116 | uGGccAGcuucGuGcGGcAdTdT | 1628 | UGCCGcACGAAGCUGGCcAdTdT |
| AD-20386 | 436 | 1117 | uGGucAAGccAGAGAGAGAdTdT | 1629 | UCUCUCUCUGGCUUGACcAdTdT |
| AD-20387 | 489 | 1139 | GGccAGGAGcAGcuccuudTdT | 1651 | cAAGGAGCUGCUCCUGGCCdTdT |
| AD-20388 | 490 | 1140 | GccAGGAGcAGcuccuuGAdTdT | 1652 | UcAAGGAGCUGCUCCUGGCdTdT |
| AD-20389 | 491 | 1141 | ccAGGAGcAGcuccuuGAGdTdT | 1653 | CUcAAGGAGCUGCUCCUGGdTdT |
| AD-20390 | 492 | 1142 | cAGGAGcAGcuccuuGAGAdTdT | 1654 | UCUcAAGGAGCUGCUCCUGdTdT |
| AD-20391 | 493 | 1143 | AGGAGcAGcuccuuGAGAAdTdT | 1655 | UUCUcAAGGAGCUGCUCCUdTdT |
| AD-20392 | 494 | 1144 | GGAGcAGcuccuuGAGAAcdTdT | 1656 | GUUCUcAAGGAGCUGCUCCdTdT |
| AD-20393 | 495 | 1145 | GAGcAGcuccuuGAGAAcAdTdT | 1657 | UGUUCUcAAGGAGCUGCUCdTdT |
| AD-20394 | 496 | 1146 | AGcAGcuccuuGAGAAcAudTdT | 1658 | AUGUUCUcAAGGAGCUGCUdTdT |
| AD-20395 | 497 | 1147 | GcAGcuccuuGAGAAcAucdTdT | 1659 | GAUGUUCUcAAGGAGCUGCdTdT |

TABLE 2-continued

HSF1 RNAi agents (with modified sequences)

| Duplex Name | Position | SEQ ID NO | Sense 5'-3' modified | SEQ ID NO | Antisense 5'-3' modified |
|---|---|---|---|---|---|
| AD-20396 | 498 | 1148 | cAGcuccuuGAGAAcAucAdTdT | 1660 | UGAUGUUCUcAAGGAGCUGdTdT |
| AD-20397 | 499 | 1149 | AGcuccuuGAGAAcAucAAdTdT | 1661 | UUGAUGUUCUcAAGGAGCUdTdT |
| AD-20398 | 500 | 1150 | GcuccuuGAGAAcAucAAGdTdT | 1662 | CUUGAUGUUCUcAAGGAGCdTdT |
| AD-20399 | 501 | 1151 | cuccuuGAGAAcAucAAGAdTdT | 1663 | UCUUGAUGUUCUcAAGGAGdTdT |
| AD-20400 | 502 | 1152 | uccuuGAGAAcAucAAGAGdTdT | 1664 | CUCUUGAUGUUCUcAAGGAdTdT |
| AD-20401 | 503 | 1153 | ccuuGAGAAcAucAAGAGGdTdT | 1665 | CCUCUUGAUGUUCUcAAGGdTdT |
| AD-20402 | 504 | 1154 | cuuGAGAAcAucAAGAGGAdTdT | 1666 | UCCUCUUGAUGUUCUcAAGdTdT |
| AD-20403 | 505 | 1155 | uuGAGAAcAucAAGAGGAAdTdT | 1667 | UUCCUCUUGAUGUUCUcAAdTdT |
| AD-20404 | 506 | 1156 | uGAGAAcAucAAGAGGAAAdTdT | 1668 | UUUCCUCUUGAUGUUCUcAdTdT |
| AD-20405 | 509 | 1159 | GAAcAucAAGAGGAAAGuGdTdT | 1671 | cACUUUCCUCUUGAUGUUCdTdT |
| AD-20406 | 510 | 1160 | AAcAucAAGAGGAAAGuGAdTdT | 1672 | UcACUUUCCUCUUGAUGUUdTdT |
| AD-20407 | 511 | 1161 | AcAucAAGAGGAAAGuGAcdTdT | 1673 | GUcACUUUCCUCUUGAUGUdTdT |
| AD-20408 | 512 | 1162 | cAucAAGAGGAAAGuGAccdTdT | 1674 | GGUcACUUUCCUCUUGAUGdTdT |
| AD-20409 | 513 | 1163 | AucAAGAGGAAAGuGAccAdTdT | 1675 | UGGUcACUUUCCUCUUGAUdTdT |
| AD-20410 | 514 | 1164 | ucAAGAGGAAAGuGAccAGdTdT | 1676 | CUGGUcACUUUCCUCUUGAdTdT |
| AD-20411 | 515 | 1165 | cAAGAGGAAAGuGAccAGudTdT | 1677 | ACUGGUcACUUUCCUCUUGdTdT |
| AD-20412 | 516 | 1166 | AAGAGGAAAGuGAccAGuGdTdT | 1678 | cACUGGUcACUUUCCUCUUdTdT |
| AD-20413 | 517 | 2046 | AGAGGAAAGuGAccAGuGudTdT | 2047 | AcACUGGUcACUUUCCUCUdTdT |
| AD-20414 | 518 | 1167 | GAGGAAAGuGAccAGuGuGdTdT | 1679 | cAcACUGGUcACUUUCCUCdTdT |
| AD-20415 | 519 | 1168 | AGGAAAGuGAccAGuGuGudTdT | 1680 | AcAcACUGGUcACUUUCCUdTdT |
| AD-20416 | 520 | 1169 | GGAAAGuGAccAGuGuGucdTdT | 1681 | GAcAcACUGGUcACUUUCCdTdT |
| AD-20417 | 521 | 1170 | GAAAGuGAccAGuGuGuccdTdT | 1682 | GGAcAcACUGGUcACUUUCdTdT |
| AD-20418 | 522 | 1171 | AAAGuGAccAGuGuGuccAdTdT | 1683 | UGGAcAcACUGGUcACUUUdTdT |
| AD-20419 | 523 | 1172 | AAGuGAccAGuGuGuccAcdTdT | 1684 | GUGGAcAcACUGGUcACUUdTdT |
| AD-20420 | 524 | 1173 | AGuGAccAGuGuGuccAccdTdT | 1685 | GGUGGAcAcACUGGUcACUdTdT |
| AD-20421 | 525 | 1174 | GuGAccAGuGuGuccAcccdTdT | 1686 | GGGUGGAcAcACUGGUcACdTdT |
| AD-20422 | 526 | 1175 | uGAccAGuGuGuccAcccudTdT | 1687 | AGGGUGGAcAcACUGGUcAdTdT |
| AD-20423 | 527 | 1176 | GAccAGuGuGuccAcccuGdTdT | 1688 | cAGGGUGGAcAcACUGGUCdTdT |
| AD-20424 | 528 | 1177 | AccAGuGuGuccAcccuGAdTdT | 1689 | UcAGGGUGGAcAcACUGGUdTdT |
| AD-20425 | 529 | 1178 | ccAGuGuGuccAcccuGAAdTdT | 1690 | UUcAGGGUGGAcAcACUGGdTdT |
| AD-20426 | 530 | 1179 | cAGuGuGuccAcccuGAAGdTdT | 1691 | CUUcAGGGUGGAcAcACUGdTdT |
| AD-20427 | 531 | 1180 | AGuGuGuccAcccuGAAGAdTdT | 1692 | UCUUcAGGGUGGAcAcACUdTdT |
| AD-20428 | 532 | 1181 | GuGuGuccAcccuGAAGAGdTdT | 1693 | CUCUUcAGGGUGGAcAcACdTdT |
| AD-20429 | 533 | 1182 | uGuGuccAcccuGAAGAGudTdT | 1694 | ACUCUUcAGGGUGGAcAcAdTdT |
| AD-20430 | 534 | 1183 | GuGuccAcccuGAAGAGuGdTdT | 1695 | cACUCUUcAGGGUGGAcACdTdT |
| AD-20431 | 535 | 1184 | uGuccAcccuGAAGAGuGAdTdT | 1696 | UcACUCUUcAGGGUGGAcAdTdT |
| AD-20432 | 536 | 1185 | GuccAcccuGAAGAGuGAAdTdT | 1697 | UUcACUCUUcAGGGUGGACdTdT |
| AD-20433 | 537 | 1186 | uccAcccuGAAGAGuGAAGdTdT | 1698 | CUUcACUCUUcAGGGUGGAdTdT |

TABLE 2-continued

HSF1 RNAi agents (with modified sequences)

| Duplex Name | Position | SEQ ID NO | Sense 5'-3'modified | SEQ ID NO | Antisense 5'-3' modified |
|---|---|---|---|---|---|
| AD-20434 | 538 | 1187 | ccAcccuGAAGAGuGAAGAdTdT | 1699 | UCUUcACUCUUcAGGGUGGdTdT |
| AD-20435 | 539 | 1188 | cAcccuGAAGAGuGAAGAcdTdT | 1700 | GUCUUcACUCUUcAGGGUGdTdT |
| AD-20436 | 540 | 1189 | AcccuGAAGAGuGAAGAcAdTdT | 1701 | UGUCUUcACUCUUcAGGGUdTdT |
| AD-20437 | 541 | 1190 | cccuGAAGAGuGAAGAcAudTdT | 1702 | AUGUCUUcACUCUUcAGGGdTdT |
| AD-20438 | 542 | 1191 | ccuGAAGAGuGAAGAcAuAdTdT | 1703 | uAUGUCUUcACUCUUcAGGdTdT |
| AD-20439 | 543 | 1192 | cuGAAGAGuGAAGAcAuAAdTdT | 1704 | UuAUGUCUUcACUCUUcAGdTdT |
| AD-20487 | 544 | 1193 | uGAAGAGuGAAGAcAuAAAdTdT | 1705 | UUuAUGUCUUcACUCUUcAdTdT |
| AD-20488 | 545 | 1194 | GAAGAGuGAAGAcAuAAAGdTdT | 1706 | CUUuAUGUCUUcACUCUUCdTdT |
| AD-20489 | 546 | 1195 | AAGAGuGAAGAcAuAAAGAdTdT | 1707 | UCUUuAUGUCUUcACUCUUdTdT |
| AD-20490 | 547 | 1196 | AGAGuGAAGAcAuAAAGAudTdT | 1708 | AUCUUuAUGUCUUcACUCUdTdT |
| AD-20491 | 548 | 1197 | GAGuGAAGAcAuAAAGAucdTdT | 1709 | GAUCUUuAUGUCUUcACUCdTdT |
| AD-20492 | 549 | 1198 | AGuGAAGAcAuAAAGAuccdTdT | 1710 | GGAUCUUuAUGUCUUcACUdTdT |
| AD-20493 | 550 | 1199 | GuGAAGAcAuAAAGAuccGdTdT | 1711 | CGGAUCUUuAUGUCUUcACdTdT |
| AD-20494 | 579 | 1200 | GucAccAAGcuGcuGAcGGdTdT | 1712 | CCGUcAGcAGCUUGGUGACdTdT |
| AD-20495 | 580 | 1201 | ucAccAAGcuGcuGAcGGAdTdT | 1713 | UCCGUcAGcAGCUUGGUGAdTdT |
| AD-20496 | 581 | 1202 | cAccAAGcuGcuGAcGGAcdTdT | 1714 | GUCCGUcAGcAGCUUGGUGdTdT |
| AD-20497 | 582 | 1203 | AccAAGcuGcuGAcGGAcGdTdT | 1715 | CGUCCGUcAGcAGCUUGGUdTdT |
| AD-20498 | 583 | 1204 | ccAAGcuGcuGAcGGAcGudTdT | 1716 | ACGUCCGUcAGcAGCUUGGdTdT |
| AD-20499 | 584 | 1205 | cAAGcuGcuGAcGGAcGuGdTdT | 1717 | cACGUCCGUcAGcAGCUUGdTdT |
| AD-20500 | 585 | 1206 | AAGcuGcuGAcGGAcGuGcdTdT | 1718 | GcACGUCCGUcAGcAGCUUdTdT |
| AD-20501 | 586 | 1207 | AGcuGcuGAcGGAcGuGcAdTdT | 1719 | UGcACGUCCGUcAGcAGCUdTdT |
| AD-20502 | 587 | 1208 | GcuGcuGAcGGAcGuGcAGdTdT | 1720 | CUGcACGUCCGUcAGcAGCdTdT |
| AD-20503 | 588 | 1209 | cuGcuGAcGGAcGuGcAGcdTdT | 1721 | GCUGcACGUCCGUcAGcAGdTdT |
| AD-20504 | 589 | 1210 | uGcuGAcGGAcGuGcAGcudTdT | 1722 | AGCUGcACGUCCGUcAGcAdTdT |
| AD-20505 | 590 | 1211 | GcuGAcGGAcGuGcAGcuGdTdT | 1723 | cAGCUGcACGUCCGUcAGCdTdT |
| AD-20506 | 591 | 1212 | cuGAcGGAcGuGcAGcuGAdTdT | 1724 | UcAGCUGcACGUCCGUcAGdTdT |
| AD-20507 | 592 | 1213 | uGAcGGAcGuGcAGcuGAudTdT | 1725 | AUcAGCUGcACGUCCGUcAdTdT |
| AD-20508 | 593 | 1214 | GAcGGAcGuGcAGcuGAuGdTdT | 1726 | cAUcAGCUGcACGUCCGUCdTdT |
| AD-20509 | 594 | 1215 | AcGGAcGuGcAGcuGAuGAdTdT | 1727 | UcAUcAGCUGcACGUCCGUdTdT |
| AD-20510 | 595 | 1216 | cGGAcGuGcAGcuGAuGAAdTdT | 1728 | UUcAUcAGCUGcACGUCCGdTdT |
| AD-20511 | 596 | 1217 | GGAcGuGcAGcuGAuGAAGdTdT | 1729 | CUUcAUcAGCUGcACGUCCdTdT |
| AD-20512 | 597 | 1218 | GAcGuGcAGcuGAuGAAGGdTdT | 1730 | CCUUcAUcAGCUGcACGUCdTdT |
| AD-20513 | 598 | 1219 | AcGuGcAGcuGAuGAAGGGdTdT | 1731 | CCCUUcAUcAGCUGcACGUdTdT |
| AD-20514 | 660 | 1220 | GAGAAuGAGGcucuGuGGcdTdT | 1732 | GCcAcAGAGCCUcAUUCUCdTdT |
| AD-20515 | 661 | 1221 | AGAAuGAGGcucuGuGGcGdTdT | 1733 | CGCcAcAGAGCCUcAUUCUdTdT |
| AD-20516 | 662 | 1222 | GAAuGAGGcucuGuGGcGGdTdT | 1734 | CCGCcAcAGAGCCUcAUUCdTdT |
| AD-20517 | 663 | 1223 | AAuGAGGcucuGuGGcGGGdTdT | 1735 | CCCGCcAcAGAGCCUcAUUdTdT |

TABLE 2-continued

HSF1 RNAi agents (with modified sequences)

| Duplex Name | Position | SEQ ID NO | Sense 5'-3' modified | SEQ ID NO | Antisense 5'-3' modified |
|---|---|---|---|---|---|
| AD-20518 | 664 | 1224 | AuGAGGcucuGuGGcGGGAdTdT | 1736 | UCCCGCcAcAGAGCCUcAUdTdT |
| AD-20519 | 665 | 1225 | uGAGGcucuGuGGcGGGAGdTdT | 1737 | CUCCCGCcAcAGAGCCUcAdTdT |
| AD-20520 | 666 | 1226 | GAGGcucuGuGGcGGGAGGdTdT | 1738 | CCUCCCGCcAcAGAGCCUCdTdT |
| AD-20521 | 667 | 1227 | AGGcucuGuGGcGGGAGGudTdT | 1739 | ACCUCCCGCcAcAGAGCCUdTdT |
| AD-20522 | 668 | 1228 | GGcucuGuGGcGGGAGGuGdTdT | 1740 | cACCUCCCGCcAcAGAGCCdTdT |
| AD-20523 | 669 | 1229 | GcucuGuGGcGGGAGGuGGdTdT | 1741 | CcACCUCCCGCcAcAGAGCdTdT |
| AD-20524 | 670 | 1230 | cucuGuGGcGGGAGGuGGcdTdT | 1742 | GCcACCUCCCGCcAcAGAdTdT |
| AD-20525 | 671 | 1231 | ucuGuGGcGGGAGGuGGccdTdT | 1743 | GGCcACCUCCCGCcAcAGAdTdT |
| AD-20526 | 672 | 1232 | cuGuGGcGGGAGGuGGccAdTdT | 1744 | UGGCcACCUCCCGCcAcAGdTdT |
| AD-20527 | 673 | 1233 | uGuGGcGGGAGGuGGccAGdTdT | 1745 | CUGGCcACCUCCCGCcAcAdTdT |
| AD-20528 | 674 | 1234 | GuGGcGGGAGGuGGccAGcdTdT | 1746 | GCUGGCcACCUCCCGCcACdTdT |
| AD-20529 | 675 | 1235 | uGGcGGGAGGuGGccAGccdTdT | 1747 | GGCUGGCcACCUCCCGCcAdTdT |
| AD-20530 | 676 | 1236 | GGcGGGAGGuGGccAGccudTdT | 1748 | AGGCUGGCcACCUCCCGCCdTdT |
| AD-20531 | 677 | 1237 | GcGGGAGGuGGccAGccuudTdT | 1749 | AAGGCUGGCcACCUCCCGCdTdT |
| AD-20532 | 678 | 1238 | cGGGAGGuGGccAGccuucdTdT | 1750 | GAAGGCUGGCcACCUCCCGdTdT |
| AD-20533 | 679 | 1239 | GGGAGGuGGccAGccuucGdTdT | 1751 | CGAAGGCUGGCcACCUCCCdTdT |
| AD-20534 | 680 | 1240 | GGAGGuGGccAGccuucGGdTdT | 1752 | CCGAAGGCUGGCcACCUCCdTdT |
| AD-20535 | 681 | 1241 | GAGGuGGccAGccuucGGcdTdT | 1753 | GCCGAAGGCUGGCcACCUCdTdT |
| AD-20536 | 682 | 1242 | AGGuGGccAGccuucGGcAdTdT | 1754 | UGCCGAAGGCUGGCcACCUdTdT |
| AD-20537 | 683 | 1243 | GGuGGccAGccuucGGcAGdTdT | 1755 | CUGCCGAAGGCUGGCcACCdTdT |
| AD-20538 | 684 | 1244 | GuGGccAGccuucGGcAGAdTdT | 1756 | UCUGCCGAAGGCUGGCcACdTdT |
| AD-20539 | 685 | 1245 | uGGccAGccuucGGcAGAAdTdT | 1757 | UUCUGCCGAAGGCUGGCcAdTdT |
| AD-20540 | 690 | 1250 | AGccuucGGcAGAAGcAuGdTdT | 1762 | cAUGCUUCUGCCGAAGGCUdTdT |
| AD-20541 | 691 | 1251 | GccuucGGcAGAAGcAuGcdTdT | 1763 | GcAUGCUUCUGCCGAAGGCdTdT |
| AD-20542 | 692 | 1252 | ccuucGGcAGAAGcAuGccdTdT | 1764 | GGcAUGCUUCUGCCGAAGGdTdT |
| AD-20543 | 693 | 1253 | cuucGGcAGAAGcAuGcccdTdT | 1765 | GGGcAUGCUUCUGCCGAAGdTdT |
| AD-20544 | 694 | 1254 | uucGGcAGAAGcAuGcccAdTdT | 1766 | UGGGcAUGCUUCUGCCGAAdTdT |
| AD-20545 | 695 | 1255 | ucGGcAGAAGcAuGcccAGdTdT | 1767 | CUGGGcAUGCUUCUGCCGAdTdT |
| AD-20546 | 696 | 1256 | cGGcAGAAGcAuGcccAGcdTdT | 1768 | GCUGGGcAUGCUUCUGCCGdTdT |
| AD-20547 | 697 | 1257 | GGcAGAAGcAuGcccAGcAdTdT | 1769 | UGCUGGGcAUGCUUCUGCCdTdT |
| AD-20548 | 698 | 1258 | GcAGAAGcAuGcccAGcAAdTdT | 1770 | UUGCUGGGcAUGCUUCUGCdTdT |
| AD-20549 | 699 | 1259 | cAGAAGcAuGcccAGcAAcdTdT | 1771 | GUUGCUGGGcAUGCUUCUGdTdT |
| AD-20550 | 700 | 1260 | AGAAGcAuGcccAGcAAcAdTdT | 1772 | UGUUGCUGGGcAUGCUUCUdTdT |
| AD-20551 | 701 | 1261 | GAAGcAuGcccAGcAAcAGdTdT | 1773 | CUGUUGCUGGGcAUGCUUCdTdT |
| AD-20552 | 702 | 1262 | AAGcAuGcccAGcAAcAGAdTdT | 1774 | UCUGUUGCUGGGcAUGCUUdTdT |
| AD-20553 | 703 | 1263 | AGcAuGcccAGcAAcAGAAdTdT | 1775 | UUCUGUUGCUGGGcAUGCUdTdT |
| AD-20554 | 704 | 1264 | GcAuGcccAGcAAcAGAAAdTdT | 1776 | UUUCUGUUGCUGGGcAUGCdTdT |
| AD-20555 | 705 | 1265 | cAuGcccAGcAAcAGAAAGdTdT | 1777 | CUUUCUGUUGCUGGGcAUGdTdT |

TABLE 2-continued

HSF1 RNAi agents (with modified sequences)

| Duplex Name | Position | SEQ ID NO | Sense 5'-3' modified | SEQ ID NO | Antisense 5'-3' modified |
|---|---|---|---|---|---|
| AD-20556 | 706 | 1266 | AuGcccAGcAAcAGAAAGudTdT | 1778 | ACUUUCUGUUGCUGGGcAUdTdT |
| AD-20557 | 707 | 1267 | uGcccAGcAAcAGAAAGucdTdT | 1779 | GACUUUCUGUUGCUGGGcAdTdT |
| AD-20558 | 731 | 1291 | cAAGcucAuucAGuuccuGdTdT | 1803 | cAGGAACUGAAUGAGCUUGdTdT |
| AD-20559 | 732 | 1292 | AAGcucAuucAGuuccuGAdTdT | 1804 | UcAGGAACUGAAUGAGCUUdTdT |
| AD-20560 | 733 | 1293 | AGcucAuucAGuuccuGAudTdT | 1805 | AUcAGGAACUGAAUGAGCUdTdT |
| AD-20561 | 734 | 1294 | GcucAuucAGuuccuGAucdTdT | 1806 | GAUcAGGAACUGAAUGAGCdTdT |
| AD-20562 | 735 | 1295 | cucAuucAGuuccuGAucudTdT | 1807 | AGAUcAGGAACUGAAUGAGdTdT |
| AD-20563 | 736 | 1296 | ucAuucAGuuccuGAucucdTdT | 1808 | GAGAUcAGGAACUGAAUGAdTdT |
| AD-20564 | 737 | 1297 | cAuucAGuuccuGAucucAdTdT | 1809 | UGAGAUcAGGAACUGAAUGdTdT |
| AD-20565 | 738 | 1298 | AuucAGuuccuGAucucAcdTdT | 1810 | GUGAGAUcAGGAACUGAAUdTdT |
| AD-20566 | 739 | 1299 | uucAGuuccuGAucucAcudTdT | 1811 | AGUGAGAUcAGGAACUGAAdTdT |
| AD-20567 | 740 | 1300 | ucAGuuccuGAucucAcuGdTdT | 1812 | cAGUGAGAUcAGGAACUGAdTdT |
| AD-20568 | 741 | 1301 | cAGuuccuGAucucAcuGGdTdT | 1813 | CcAGUGAGAUcAGGAACUGdTdT |
| AD-20569 | 742 | 1302 | AGuuccuGAucucAcuGGudTdT | 1814 | ACcAGUGAGAUcAGGAACUdTdT |
| AD-20571 | 744 | 1303 | uuccuGAucucAcuGGuGcdTdT | 1815 | GcACcAGUGAGAUcAGGAAdTdT |
| AD-20572 | 745 | 1304 | uccuGAucucAcuGGuGcAdTdT | 1816 | UGcACcAGUGAGAUcAGGAdTdT |
| AD-20573 | 746 | 1305 | ccuGAucucAcuGGuGcAGdTdT | 1817 | CUGcACcAGUGAGAUcAGGdTdT |
| AD-20574 | 747 | 2048 | cuGAucucAcuGGuGcAGucdTdT | 2049 | ACUGcACcAGUGAGAUcAGdTdT |
| AD-20575 | 748 | 1306 | uGAucucAcuGGuGcAGucdTdT | 1818 | GACUGcACcAGUGAGAUcAdTdT |
| AD-20576 | 749 | 1307 | GAucucAcuGGuGcAGucAdTdT | 1819 | UGACUGcACcAGUGAGAUCdTdT |
| AD-20577 | 750 | 1308 | AucucAcuGGuGcAGucAAdTdT | 1820 | UUGACUGcACcAGUGAGAUdTdT |
| AD-20578 | 751 | 1309 | ucucAcuGGuGcAGucAAAdTdT | 1821 | UUUGACUGcACcAGUGAGAdTdT |
| AD-20579 | 752 | 1310 | cucAcuGGuGcAGucAAAcdTdT | 1822 | GUUUGACUGcAccAGUGAGdTdT |
| AD-20581 | 754 | 1311 | cAcuGGuGcAGucAAAccGdTdT | 1823 | CGGUUUGACUGcACcAGUGdTdT |
| AD-20582 | 755 | 1312 | AcuGGuGcAGucAAAccGGdTdT | 1824 | CCGGUUUGACUGcACcAGUdTdT |
| AD-20625 | 756 | 1313 | cuGGuGcAGucAAAccGGAdTdT | 1825 | UCCGGUUUGACUGcACcAGdTdT |
| AD-20626 | 757 | 1314 | uGGuGcAGucAAAccGGAudTdT | 1826 | AUCCGGUUUGACUGcACcAdTdT |
| AD-20627 | 758 | 1315 | GGuGcAGucAAAccGGAucdTdT | 1827 | GAUCCGGUUUGACUGcACCdTdT |
| AD-20628 | 759 | 1316 | GuGcAGucAAAccGGAuccdTdT | 1828 | GGAUCCGGUUUGACUGcACdTdT |
| AD-20629 | 760 | 1317 | uGcAGucAAAccGGAuccudTdT | 1829 | AGGAUCCGGUUUGACUGcAdTdT |
| AD-20630 | 761 | 1318 | GcAGucAAAccGGAuccuGdTdT | 1830 | cAGGAUCCGGUUUGACUGCdTdT |
| AD-20631 | 762 | 1319 | cAGucAAAccGGAuccuGGdTdT | 1831 | CcAGGAUCCGGUUUGACUGdTdT |
| AD-20632 | 763 | 1320 | AGucAAAccGGAuccuGGGdTdT | 1832 | CCcAGGAUCCGGUUUGACUdTdT |
| AD-20633 | 781 | 1321 | GGGuGAAGAGAAAGAucccdTdT | 1833 | GGGAUCUUUCUCUUcACCCdTdT |
| AD-20634 | 799 | 1322 | cccuGAuGcuGAAcGAcAGdTdT | 1834 | CUGUCGUUcAGcAUcAGGGdTdT |
| AD-20635 | 800 | 1323 | ccuGAuGcuGAAcGAcAGudTdT | 1835 | ACUGUCGUUcAGcAUcAGGdTdT |
| AD-20636 | 801 | 1324 | cuGAuGcuGAAcGAcAGuGdTdT | 1836 | cACUGUCGUUcAGcAUcAGdTdT |

TABLE 2-continued

HSF1 RNAi agents (with modified sequences)

| Duplex Name | Position | SEQ ID NO | Sense 5'-3'modified | SEQ ID NO | Antisense 5'-3' modified |
|---|---|---|---|---|---|
| AD-20637 | 802 | 1325 | uGAuGcuGAAcGAcAGuGGdTdT | 1837 | CcACUGUCGUUcAGcAUcAdTdT |
| AD-20638 | 803 | 1326 | GAuGcuGAAcGAcAGuGGcdTdT | 1838 | GCcACUGUCGUUcAGcAUCdTdT |
| AD-20639 | 804 | 1327 | AuGcuGAAcGAcAGuGGcudTdT | 1839 | AGCcACUGUCGUUcAGcAUdTdT |
| AD-20640 | 805 | 1328 | uGcuGAAcGAcAGuGGcucdTdT | 1840 | GAGCcACUGUCGUUcAGcAdTdT |
| AD-20641 | 806 | 1329 | GcuGAAcGAcAGuGGcucAdTdT | 1841 | UGAGCcACUGUCGUUcAGCdTdT |
| AD-20642 | 807 | 1330 | cuGAAcGAcAGuGGcucAGdTdT | 1842 | CUGAGCcACUGUCGUUcAGdTdT |
| AD-20643 | 808 | 1331 | uGAAcGAcAGuGGcucAGcdTdT | 1843 | GCUGAGCcACUGUCGUUcAdTdT |
| AD-20644 | 809 | 1332 | GAAcGAcAGuGGcucAGcAdTdT | 1844 | UGCUGAGCcACUGUCGUUCdTdT |
| AD-20645 | 810 | 1333 | AAcGAcAGuGGcucAGcAcdTdT | 1845 | GUGCUGAGCcACUGUCGUUdTdT |
| AD-20646 | 811 | 1334 | AcGAcAGuGGcucAGcAcAdTdT | 1846 | UGUGCUGAGCcACUGUCGUdTdT |
| AD-20647 | 812 | 1335 | cGAcAGuGGcucAGcAcAudTdT | 1847 | AUGUGCUGAGCcACUGUCGdTdT |
| AD-20648 | 813 | 1336 | GAcAGuGGcucAGcAcAuudTdT | 1848 | AAUGUGCUGAGCcACUGUCdTdT |
| AD-20649 | 814 | 1337 | AcAGuGGcucAGcAcAuucdTdT | 1849 | GAAUGUGCUGAGCcACUGUdTdT |
| AD-20650 | 815 | 1338 | cAGuGGcucAGcAcAuuccdTdT | 1850 | GGAAUGUGCUGAGCcACUGdTdT |
| AD-20651 | 816 | 1339 | AGuGGcucAGcAcAuuccAdTdT | 1851 | UGGAAUGUGCUGAGCcACUdTdT |
| AD-20652 | 817 | 1340 | GuGGcucAGcAcAuuccAudTdT | 1852 | AUGGAAUGUGCUGAGCcACdTdT |
| AD-20653 | 818 | 1341 | uGGcucAGcAcAuuccAuGdTdT | 1853 | cAUGGAAUGUGCUGAGCcAdTdT |
| AD-20654 | 819 | 1342 | GGcucAGcAcAuuccAuGcdTdT | 1854 | GcAUGGAAUGUGCUGAGCCdTdT |
| AD-20655 | 820 | 1343 | GcucAGcAcAuuccAuGccdTdT | 1855 | GGcAUGGAAUGUGCUGAGCdTdT |
| AD-20656 | 821 | 1344 | cucAGcAcAuuccAuGcccdTdT | 1856 | GGGcAUGGAAUGUGCUGAGdTdT |
| AD-20657 | 822 | 1345 | ucAGcAcAuuccAuGcccAdTdT | 1857 | UGGGcAUGGAAUGUGCUGAdTdT |
| AD-20658 | 823 | 1346 | cAGcAcAuuccAuGcccAAdTdT | 1858 | UUGGGcAUGGAAUGUGCUGdTdT |
| AD-20659 | 824 | 1347 | AGcAcAuuccAuGcccAAGdTdT | 1859 | CUUGGGcAUGGAAUGUGCUdTdT |
| AD-20660 | 825 | 1348 | GcAcAuuccAuGcccAAGudTdT | 1860 | ACUUGGGcAUGGAAUGUGCdTdT |
| AD-20661 | 826 | 1349 | cAcAuuccAuGcccAAGuAdTdT | 1861 | uACUUGGGcAUGGAAUGUGdTdT |
| AD-20284 | 827 | 1350 | AcAuuccAuGcccAAGuAudTdT | 1862 | AuACUUGGGcAUGGAAUGUdTdT |
| AD-20662 | 847 | 1351 | GccGGcAGuucucccuGGAdTdT | 1863 | UCcAGGGAGAACUGCCGGCdTdT |
| AD-20868 | 848 | 1352 | ccGGcAGuucucccuGGAGdTdT | 1864 | CUCcAGGGAGAACUGCCGGdTdT |
| AD-20663 | 849 | 1353 | cGGcAGuucucccuGGAGcdTdT | 1865 | GCUCcAGGGAGAACUGCCGdTdT |
| AD-20664 | 850 | 1354 | GGcAGuucucccuGGAGcAdTdT | 1866 | UGCUCcAGGGAGAACUGCCdTdT |
| AD-20665 | 851 | 1355 | GcAGuucucccuGGAGcAcdTdT | 1867 | GUGCUCcAGGGAGAACUGCdTdT |
| AD-20666 | 852 | 1356 | cAGuucucccuGGAGcAcGdTdT | 1868 | CGUGCUCcAGGGAGAACUGdTdT |
| AD-20667 | 853 | 1357 | AGuucucccuGGAGcAcGudTdT | 1869 | ACGUGCUCcAGGGAGAACUdTdT |
| AD-20668 | 854 | 1358 | GuucucccuGGAGcAcGucdTdT | 1870 | GACGUGCUCcAGGGAGAACdTdT |
| AD-20669 | 855 | 1359 | uucucccuGGAGcAcGuccdTdT | 1871 | GGACGUGCUCcAGGGAGAAdTdT |
| AD-20670 | 856 | 1360 | ucucccuGGAGcAcGuccAdTdT | 1872 | UGGACGUGCUCcAGGGAGAdTdT |
| AD-20671 | 857 | 1361 | cucccuGGAGcAcGuccAcdTdT | 1873 | GUGGACGUGCUCcAGGGAGdTdT |
| AD-20672 | 858 | 1362 | ucccuGGAGcAcGuccAcGdTdT | 1874 | CGUGGACGUGCUCcAGGGAdTdT |

TABLE 2-continued

HSF1 RNAi agents (with modified sequences)

| Duplex Name | Position | SEQ ID NO | Sense 5'-3' modified | SEQ ID NO | Antisense 5'-3' modified |
|---|---|---|---|---|---|
| AD-20673 | 859 | 1363 | cccuGGAGcAcGuccAcGGdTdT | 1875 | CCGUGGACGUGCUCcAGGGdTdT |
| AD-20674 | 860 | 1364 | ccuGGAGcAcGuccAcGGcdTdT | 1876 | GCCGUGGACGUGCUCcAGGdTdT |
| AD-20675 | 861 | 1365 | cuGGAGcAcGuccAcGGcudTdT | 1877 | AGCCGUGGACGUGCUCcAGdTdT |
| AD-20676 | 862 | 1366 | uGGAGcAcGuccAcGGcucdTdT | 1878 | GAGCCGUGGACGUGCUCcAdTdT |
| AD-20677 | 915 | 1373 | AGcuccAGccucuAcGcccdTdT | 1885 | GGGCGuAGAGGCUGGAGCUdTdT |
| AD-20678 | 965 | 1385 | cuccGAcAucAccGAGcuGdTdT | 1897 | cAGCUCGGUGAUGUCGGAGdTdT |
| AD-20679 | 966 | 1386 | uccGAcAucAccGAGcuGGdTdT | 1898 | CcAGCUCGGUGAUGUCGGAdTdT |
| AD-20680 | 967 | 1387 | ccGAcAucAccGAGcuGGcdTdT | 1899 | GCcAGCUCGGUGAUGUCGGdTdT |
| AD-20681 | 968 | 1388 | cGAcAucAccGAGcuGGcudTdT | 1900 | AGCcAGCUCGGUGAUGUCGdTdT |
| AD-20682 | 969 | 1389 | GAcAucAccGAGcuGGcucdTdT | 1901 | GAGCcAGCUCGGUGAUGUCdTdT |
| AD-20683 | 970 | 1390 | AcAucAccGAGcuGGcuccdTdT | 1902 | GGAGCcAGCUCGGUGAUGUdTdT |
| AD-20684 | 971 | 1391 | cAucAccGAGcuGGcuccudTdT | 1903 | AGGAGCcAGCUCGGUGAUGdTdT |
| AD-20685 | 972 | 1392 | AucAccGAGcuGGcuccuGdTdT | 1904 | cAGGAGCcAGCUCGGUGAUdTdT |
| AD-20686 | 973 | 1393 | ucAccGAGcuGGcuccuGcdTdT | 1905 | GcAGGAGCcAGCUCGGUGAdTdT |
| AD-20687 | 974 | 1394 | cAccGAGcuGGcuccuGccdTdT | 1906 | GGcAGGAGCcAGCUCGGUGdTdT |
| AD-20688 | 975 | 1395 | AccGAGcuGGcuccuGccAdTdT | 1907 | UGGcAGGAGCcAGCUCGGUdTdT |
| AD-20689 | 976 | 1396 | ccGAGcuGGcuccuGccAGdTdT | 1908 | CUGGcAGGAGCcAGCUCGGdTdT |
| AD-20690 | 977 | 1397 | cGAGcuGGcuccuGccAGcdTdT | 1909 | GCUGGcAGGAGCcAGCUCGdTdT |
| AD-20691 | 978 | 1398 | GAGcuGGcuccuGccAGccdTdT | 1910 | GGCUGGcAGGAGCcAGCUCdTdT |
| AD-20692 | 979 | 1399 | AGcuGGcuccuGccAGcccdTdT | 1911 | GGGCUGGcAGGAGCcAGCUdTdT |
| AD-20693 | 1011 | 1400 | GGcGGGAGcAuAGAcGAGAdTdT | 1912 | UCUCGUCuAUGCUCCCGCCdTdT |
| AD-20694 | 1012 | 1401 | GcGGGAGcAuAGAcGAGAGdTdT | 1913 | CUCUCGUCuAUGCUCCCGCdTdT |
| AD-20695 | 1013 | 1402 | cGGGAGcAuAGAcGAGAGGdTdT | 1914 | CCUCUCGUCuAUGCUCCCGdTdT |
| AD-20696 | 1014 | 1403 | GGGAGcAuAGAcGAGAGGcdTdT | 1915 | GCCUCUCGUCuAUGCUCCCdTdT |
| AD-20697 | 1015 | 1404 | GGAGcAuAGAcGAGAGGccdTdT | 1916 | GGCCUCUCGUCuAUGCUCCdTdT |
| AD-20698 | 1016 | 1405 | GAGcAuAGAcGAGAGGcccdTdT | 1917 | GGGCCUCUCGUCuAUGCUCdTdT |
| AD-20699 | 1048 | 1406 | cccuGGuGcGuGucAAGGAdTdT | 1918 | UCCUUGAcACGcACcAGGGdTdT |
| AD-20700 | 1049 | 1407 | ccuGGuGcGuGucAAGGAGdTdT | 1919 | CUCCUUGAcACGcACcAGGdTdT |
| AD-20701 | 1050 | 1408 | cuGGuGcGuGucAAGGAGGdTdT | 1920 | CCUCCUUGAcACGcACcAGdTdT |
| AD-20702 | 1051 | 1409 | uGGuGcGuGucAAGGAGGAdTdT | 1921 | UCCUCCUUGAcACGcACcAdTdT |
| AD-20869 | 1052 | 1410 | GGuGcGuGucAAGGAGGAGdTdT | 1922 | CUCCUCCUUGAcACGcACCdTdT |
| AD-20703 | 1053 | 1411 | GuGcGuGucAAGGAGGAGcdTdT | 1923 | GCUCCUCCUUGAcACGcACdTdT |
| AD-20704 | 1054 | 1412 | uGcGuGucAAGGAGGAGccdTdT | 1924 | GGCUCCUCCUUGAcACGcAdTdT |
| AD-20705 | 1055 | 1413 | GcGuGucAAGGAGGAGcccdTdT | 1925 | GGGCUCCUCCUUGAcACGcdTdT |
| AD-20706 | 1329 | 1416 | cAcuuGGAuGcuAuGGAcudTdT | 1928 | AGUCcAuAGcAUCcAAGUGdTdT |
| AD-20707 | 1330 | 1417 | AcuuGGAuGcuAuGGAcucdTdT | 1929 | GAGUCcAuAGcAUCcAAGUdTdT |
| AD-20709 | 1332 | 1418 | uuGGAuGcuAuGGAcuccAdTdT | 1930 | UGGAGUCcAuAGcAUCcAAdTdT |

TABLE 2-continued

HSF1 RNAi agents (with modified sequences)

| Duplex Name | Position | SEQ ID NO | Sense 5'-3'modified | SEQ ID NO | Antisense 5'-3' modified |
|---|---|---|---|---|---|
| AD-20710 | 1333 | 1419 | uGGAuGcuAuGGAcuccAAdTdT | 1931 | UUGGAGUCcAuAGcAUCcAdTdT |
| AD-20711 | 1334 | 1420 | GGAuGcuAuGGAcuccAAcdTdT | 1932 | GUUGGAGUCcAuAGcAUCCdTdT |
| AD-20712 | 1335 | 1421 | GAuGcuAuGGAcuccAAccdTdT | 1933 | GGUUGGAGUCcAuAGcAUCdTdT |
| AD-20713 | 1336 | 1422 | AuGcuAuGGAcuccAAccudTdT | 1934 | AGGUUGGAGUCcAuAGcAUdTdT |
| AD-20714 | 1337 | 1423 | uGcuAuGGAcuccAAccuGdTdT | 1935 | cAGGUUGGAGUCcAuAGcAdTdT |
| AD-20715 | 1338 | 1424 | GcuAuGGAcuccAAccuGGdTdT | 1936 | CcAGGUUGGAGUCcAuAGCdTdT |
| AD-20716 | 1339 | 1425 | cuAuGGAcuccAAccuGGAdTdT | 1937 | UCcAGGUUGGAGUCcAuAGdTdT |
| AD-20717 | 1359 | 1426 | AAccuGcAGAccAuGcuGAdTdT | 1938 | UcAGcAUGGUCUGcAGGUUdTdT |
| AD-20718 | 1360 | 1427 | AccuGcAGAccAuGcuGAGdTdT | 1939 | CUcAGcAUGGUCUGcAGGUdTdT |
| AD-20719 | 1361 | 1428 | ccuGcAGAccAuGcuGAGcdTdT | 1940 | GCUcAGcAUGGUCUGcAGGdTdT |
| AD-20720 | 1362 | 1429 | cuGcAGAccAuGcuGAGcAdTdT | 1941 | UGCUcAGcAUGGUCUGcAGdTdT |
| AD-20721 | 1363 | 1430 | uGcAGAccAuGcuGAGcAGdTdT | 1942 | CUGCUcAGcAUGGUCUGcAdTdT |
| AD-20722 | 1364 | 1431 | GcAGAccAuGcuGAGcAGcdTdT | 1943 | GCUGCUcAGcAUGGUCUGCdTdT |
| AD-20723 | 1365 | 1432 | cAGAccAuGcuGAGcAGccdTdT | 1944 | GGCUGCUcAGcAUGGUCUGdTdT |
| AD-20724 | 1366 | 1433 | AGAccAuGcuGAGcAGccAdTdT | 1945 | UGGCUGCUcAGcAUGGUCUdTdT |
| AD-20725 | 1367 | 1434 | GAccAuGcuGAGcAGccAcdTdT | 1946 | GUGGCUGCUcAGcAUGGUCdTdT |
| AD-20726 | 1368 | 1435 | AccAuGcuGAGcAGccAcGdTdT | 1947 | CGUGGCUGCUcAGcAUGGUdTdT |
| AD-20727 | 1369 | 1436 | ccAuGcuGAGcAGccAcGGdTdT | 1948 | CCGUGGCUGCUcAGcAUGGdTdT |
| AD-20728 | 1370 | 1437 | cAuGcuGAGcAGccAcGGcdTdT | 1949 | GCCGUGGCUGCUcAGcAUGdTdT |
| AD-20729 | 1371 | 1438 | AuGcuGAGcAGccAcGGcudTdT | 1950 | AGCCGUGGCUGCUcAGcAUdTdT |
| AD-20730 | 1372 | 1439 | uGcuGAGcAGccAcGGcuudTdT | 1951 | AAGCCGUGGCUGCUcAGcAdTdT |
| AD-20731 | 1373 | 1440 | GcuGAGcAGccAcGGcuucdTdT | 1952 | GAAGCCGUGGCUGCUcAGCdTdT |
| AD-20732 | 1374 | 1441 | cuGAGcAGccAcGGcuucAdTdT | 1953 | UGAAGCCGUGGCUGCUcAGdTdT |
| AD-20733 | 1375 | 1442 | uGAGcAGccAcGGcuucAGdTdT | 1954 | CUGAAGCCGUGGCUGCUcAdTdT |
| AD-20734 | 1379 | 1446 | cAGccAcGGcuucAGcGuGdTdT | 1958 | cACGCUGAAGCCGUGGCUGdTdT |
| AD-20735 | 1380 | 1447 | AGccAcGGcuucAGcGuGGdTdT | 1959 | CcACGCUGAAGCCGUGGCUdTdT |
| AD-20736 | 1381 | 1448 | GccAcGGcuucAGcGuGGAdTdT | 1960 | UCcACGCUGAAGCCGUGGCdTdT |
| AD-20737 | 1382 | 1449 | ccAcGGcuucAGcGuGGAcdTdT | 1961 | GUCcACGCUGAAGCCGUGGdTdT |
| AD-20738 | 1383 | 1450 | cAcGGcuucAGcGuGGAcAdTdT | 1962 | UGUCcACGCUGAAGCCGUGdTdT |
| AD-20739 | 1384 | 1451 | AcGGcuucAGcGuGGAcAcdTdT | 1963 | GUGUCcACGCUGAAGCCGUdTdT |
| AD-20740 | 1385 | 1452 | cGGcuucAGcGuGGAcAccdTdT | 1964 | GGUGUCcACGCUGAAGCCGdTdT |
| AD-20741 | 1386 | 1453 | GGcuucAGcGuGGAcAccAdTdT | 1965 | UGGUGUCcACGCUGAAGCCdTdT |
| AD-20742 | 1387 | 1454 | GcuucAGcGuGGAcAccAGdTdT | 1966 | CUGGUGUCcACGCUGAAGCdTdT |
| AD-20743 | 1407 | 1455 | GcccuGcuGGAccuGuucAdTdT | 1967 | UGAAcAGGUCcAGcAGGGCdTdT |
| AD-20744 | 1408 | 1456 | cccuGcuGGAccuGuucAGdTdT | 1968 | CUGAAcAGGUCcAGcAGGGdTdT |
| AD-20745 | 1409 | 1457 | ccuGcuGGAccuGuucAGcdTdT | 1969 | GCUGAAcAGGUCcAGcAGGdTdT |
| AD-20746 | 1410 | 1458 | cuGcuGGAccuGuucAGccdTdT | 1970 | GGCUGAAcAGGUCcAGcAGdTdT |
| AD-20747 | 1411 | 1459 | uGcuGGAccuGuucAGcccdTdT | 1971 | GGGCUGAAcAGGUCcAGcAdTdT |

TABLE 2-continued

HSF1 RNAi agents (with modified sequences)

| Duplex Name | Position | SEQ ID NO | Sense 5'-3' modified | SEQ ID NO | Antisense 5'-3' modified |
|---|---|---|---|---|---|
| AD-20748 | 1428 | 1460 | cccucGGuGAccGuGcccGdTdT | 1972 | CGGGcACGGUcACCGAGGGdTdT |
| AD-20749 | 1429 | 1461 | ccucGGuGAccGuGcccGAdTdT | 1973 | UCGGGcACGGUcACCGAGGdTdT |
| AD-20750 | 1430 | 1462 | cucGGuGAccGuGcccGAcdTdT | 1974 | GUCGGGcACGGUcACCGAGdTdT |
| AD-20751 | 1431 | 1463 | ucGGuGAccGuGcccGAcAdTdT | 1975 | UGUCGGGcACGGUcACCGAdTdT |
| AD-20752 | 1432 | 1464 | cGGuGAccGuGcccGAcAudTdT | 1976 | AUGUCGGGcACGGUcACCGdTdT |
| AD-20753 | 1433 | 1465 | GGuGAccGuGcccGAcAuGdTdT | 1977 | cAUGUCGGGcACGGUcACCdTdT |
| AD-20754 | 1434 | 1466 | GuGAccGuGcccGAcAuGAdTdT | 1978 | UcAUGUCGGGcACGGUcACdTdT |
| AD-20755 | 1435 | 1467 | uGAccGuGcccGAcAuGAGdTdT | 1979 | CUcAUGUCGGGcACGGUcAdTdT |
| AD-20756 | 1436 | 1468 | GAccGuGcccGAcAuGAGcdTdT | 1980 | GCUcAUGUCGGGcACGGUcdTdT |
| AD-20757 | 1437 | 1469 | AccGuGcccGAcAuGAGccdTdT | 1981 | GGCUcAUGUCGGGcACGGUdTdT |
| AD-20758 | 1438 | 1470 | ccGuGcccGAcAuGAGccudTdT | 1982 | AGGCUcAUGUCGGGcACGGdTdT |
| AD-20759 | 1439 | 1471 | cGuGcccGAcAuGAGccuGdTdT | 1983 | cAGGCUcAUGUCGGGcACGdTdT |
| AD-20760 | 1440 | 1472 | GuGcccGAcAuGAGccuGcdTdT | 1984 | GcAGGCUcAUGUCGGGcACdTdT |
| AD-20761 | 1441 | 1473 | uGcccGAcAuGAGccuGccdTdT | 1985 | GGcAGGCUcAUGUCGGGcAdTdT |
| AD-20762 | 1442 | 1474 | GcccGAcAuGAGccuGccudTdT | 1986 | AGGcAGGCUcAUGUCGGGcdTdT |
| AD-20763 | 1443 | 1475 | cccGAcAuGAGccuGccuGdTdT | 1987 | cAGGcAGGCUcAUGUCGGGdTdT |
| AD-20764 | 1444 | 1476 | ccGAcAuGAGccuGccuGAdTdT | 1988 | UcAGGcAGGCUcAUGUCGGdTdT |
| AD-20765 | 1445 | 1477 | cGAcAuGAGccuGccuGAcdTdT | 1989 | GUcAGGcAGGCUcAUGUCGdTdT |
| AD-20766 | 1446 | 1478 | GAcAuGAGccuGccuGAccdTdT | 1990 | GGUcAGGcAGGCUcAUGUCdTdT |
| AD-20767 | 1447 | 1479 | AcAuGAGccuGccuGAccudTdT | 1991 | AGGUcAGGcAGGCUcAUGUdTdT |
| AD-20768 | 1448 | 1480 | cAuGAGccuGccuGAccuudTdT | 1992 | AAGGUcAGGcAGGCUcAUGdTdT |
| AD-20769 | 1449 | 1481 | AuGAGccuGccuGAccuuGdTdT | 1993 | cAAGGUcAGGcAGGCUcAUdTdT |
| AD-20770 | 1450 | 1482 | uGAGccuGccuGAccuuGAdTdT | 1994 | UcAAGGUcAGGcAGGCUcAdTdT |
| AD-20771 | 1451 | 1483 | GAGccuGccuGAccuuGAcdTdT | 1995 | GUcAAGGUcAGGcAGGCUcdTdT |
| AD-20772 | 1452 | 1484 | AGccuGccuGAccuuGAcAdTdT | 1996 | UGUcAAGGUcAGGcAGGCUdTdT |
| AD-20773 | 1453 | 1485 | GccuGccuGAccuuGAcAGdTdT | 1997 | CUGUcAAGGUcAGGcAGGCdTdT |
| AD-20774 | 1454 | 1486 | ccuGccuGAccuuGAcAGcdTdT | 1998 | GCUGUcAAGGUcAGGcAGGdTdT |
| AD-20775 | 1455 | 1487 | cuGccuGAccuuGAcAGcAdTdT | 1999 | UGCUGUcAAGGUcAGGcAGdTdT |
| AD-20776 | 1456 | 1488 | uGccuGAccuuGAcAGcAGdTdT | 2000 | CUGCUGUcAAGGUcAGGcAdTdT |
| AD-20777 | 1457 | 1489 | GccuGAccuuGAcAGcAGcdTdT | 2001 | GCUGCUGUcAAGGUcAGGcdTdT |
| AD-20778 | 1458 | 1490 | ccuGAccuuGAcAGcAGccdTdT | 2002 | GGCUGCUGUcAAGGUcAGGdTdT |
| AD-20779 | 1459 | 1491 | cuGAccuuGAcAGcAGccudTdT | 2003 | AGGCUGCUGUcAAGGUcAGdTdT |
| AD-20780 | 1460 | 1492 | uGAccuuGAcAGcAGccuGdTdT | 2004 | cAGGCUGCUGUcAAGGUcAdTdT |
| AD-20781 | 1461 | 1493 | GAccuuGAcAGcAGccuGGdTdT | 2005 | CcAGGCUGCUGUcAAGGUcdTdT |
| AD-20782 | 1462 | 1494 | AccuuGAcAGcAGccuGGcdTdT | 2006 | GCcAGGCUGCUGUcAAGGUdTdT |
| AD-20783 | 1482 | 1495 | AGuAuccAAGAGcuccuGudTdT | 2007 | AcAGGAGCUCUUGGAuACUdTdT |
| AD-20784 | 1483 | 1496 | GuAuccAAGAGcuccuGucdTdT | 2008 | GAcAGGAGCUCUUGGAuACdTdT |

TABLE 2-continued

HSF1 RNAi agents (with modified sequences)

| Duplex Name | Position | SEQ ID NO | Sense 5'-3'modified | SEQ ID NO | Antisense 5'-3' modified |
|---|---|---|---|---|---|
| AD-20785 | 1484 | 1497 | uAuccAAGAGcuccuGucudTdT | 2009 | AGAcAGGAGCUCUUGGAuAdTdT |
| AD-20786 | 1485 | 1498 | AuccAAGAGcuccuGucucdTdT | 2010 | GAGAcAGGAGCUCUUGGAUdTdT |
| AD-20787 | 1486 | 1499 | uccAAGAGcuccuGucuccdTdT | 2011 | GGAGAcAGGAGCUCUUGGAdTdT |
| AD-20788 | 1487 | 1500 | ccAAGAGcuccuGucucccdTdT | 2012 | GGGAGAcAGGAGCUCUUGGdTdT |
| AD-20789 | 1547 | 1515 | GGAuucAGGGAAGcAGcuGdTdT | 2027 | cAGCUGCUUCCCUGAAUCCdTdT |
| AD-20790 | 1548 | 1516 | GAuucAGGGAAGcAGcuGGdTdT | 2028 | CcAGCUGCUUCCCUGAAUCdTdT |
| AD-20791 | 1549 | 1517 | AuucAGGGAAGcAGcuGGudTdT | 2029 | ACcAGCUGCUUCCCUGAAUdTdT |
| AD-20792 | 1602 | 1518 | cccGGcuccGuGGAcAccGdTdT | 2030 | CGGUGUCcACGGAGCCGGdTdT |
| AD-20793 | 1603 | 1519 | ccGGcuccGuGGAcAccGGdTdT | 2031 | CCGGUGUCcACGGAGCCGGdTdT |
| AD-20794 | 1604 | 1520 | cGGcuccGuGGAcAccGGGdTdT | 2032 | CCCGGUGUCcACGGAGCCGdTdT |
| AD-20795 | 1605 | 1521 | GGcuccGuGGAcAccGGGAdTdT | 2033 | UCCCGGUGUCcACGGAGCCdTdT |
| AD-20796 | 1606 | 1522 | GcuccGuGGAcAccGGGAGdTdT | 2034 | CUCCCGGUGUCcACGGAGCdTdT |
| AD-20870 | 1607 | 1523 | cuccGuGGAcAccGGGAGcdTdT | 2035 | GCUCCCGGUGUCcACGGAGdTdT |
| AD-20871 | 1608 | 1524 | uccGuGGAcAccGGGAGcAdTdT | 2036 | UGCUCCCGGUGUCcACGGAdTdT |
| AD-20872 | 1633 | 1525 | uGccGGuGcuGuuuGAGcudTdT | 2037 | AGCUcAAAcAGcACCGGcAdTdT |
| AD-20797 | 1634 | 1526 | GccGGuGcuGuuuGAGcuGdTdT | 2038 | GAGCUcAAAcAGcACCGGCdTdT |
| AD-20798 | 1635 | 1527 | ccGGuGcuGuuuGAGcuGGdTdT | 2039 | CcAGCUcAAAcAGcACCGGdTdT |
| AD-20799 | 1636 | 1528 | cGGuGcuGuuuGAGcuGGGdTdT | 2040 | CCcAGCUcAAAcAGcACCGdTdT |
| AD-20873 | 1698 | 1529 | cccAccAucucccuGcuGAdTdT | 2041 | UcAGcAGGGAGAUGGUGGGdTdT |
| AD-20800 | 1699 | 1530 | ccAccAucucccuGcuGAcdTdT | 3282 | GUcAGcAGGGAGAUGGUGGdTdT |
| AD-20801 | 1700 | 1531 | cAccAucucccuGcuGAcAdTdT | 3283 | UGUcAGcAGGGAGAUGGUGdTdT |
| AD-20278 | | 2075 | GcAGGuuGuucAuAGucAGdTdT | 2086 | CUGACuAUGAAcAACCUGCdTdT |
| AD-20279 | | 2076 | cAGGuuGuucAuAGucAGAdTdT | 2087 | UCUGACuAUGAAcAACCUGdTdT |
| AD-20280 | | 2077 | AGGuuGuucAuAGucAGAAdTdT | 2088 | UUCUGACuAUGAAcAACCUdTdT |
| AD-20281 | | 2078 | GcccAAGuAcuucAAGcAcdTdT | 2089 | GUGCUUGAAGuACUUGGGCdTdT |
| AD-20282 | | 2079 | cccAAGuAcuucAAGcAcAdTdT | 2090 | UGUGCUUGAAGuACUUGGGdTdT |
| AD-20283 | | 2080 | ccAAGuAcuucAAGcAcAAdTdT | 2091 | UUGUGCUUGAAGuACUUGGdTdT |
| AD-20377 | | 2081 | cAAcAAcAuGGccAGcuucdTdT | 2092 | GAAGCUGGCcAUGUUGUUGdTdT |
| AD-20570 | | 2082 | GuuccuGAucucAcuGGuGdTdT | 2093 | cACcAGUGAGAUcAGGAACdTdT |
| AD-20580 | | 2083 | ucAcuGGuGcAGucAAAccdTdT | 2094 | GGUUUGACUGcACcAGUGAdTdT |
| AD-20597 | | 2084 | UUGGUcAGGAAGGCCGGGAdTdT | 2095 | ucccGGccuuccuGAccAAdTdT |
| AD-20598 | | 2085 | cccGGccuuccuGAccAAGdTdT | 2096 | CUUGGUcAGGAAGGCCGGGdTdT |

Abbreviations in the nucleotide sequences herein are as depicted in Table 2A.

TABLE 2A

| ABBREVIATIONS | |
|---|---|
| Abbreviation | Nucleotide(s) |
| A | adenosine-5'-phosphate |
| C | cytidine-5'-phosphate |
| G | guanosine-5'-phosphate |
| dT | 2'-deoxy-thymidine-5'-phosphate |
| U | uridine-5'-phosphate |
| c | 2'-O-methylcytidine-5'-phosphate |
| u | 2'-O-methyluridine-5'-phosphate |
| Ts | 2'-deoxy-thymidine-5'-phosphorothioate |
| Q128 | 5'-(6-hydroxy hexyl) phosphate |
| idT | inverted 2'-deoxythymidine-3'-phosphate |
| Ab | beta-L-adenosine-3'-phosphate |

TABLE 2A-continued

| ABBREVIATIONS | |
|---|---|
| Abbreviation | Nucleotide(s) |
| Ub | beta-L-uridine-3'-phosphate |
| Cb | beta-L-cytidine-3'-phosphate |

The RNAi agents listed in Table 2 were prepared, as described in Example 2.

Modified sequences were conceived for other 19-mers listed in Table 1. These modified sequences are listed in Table 3. As with Table 2, the modified sequences in Table 3 are examples and non-limiting; alternative modifications are easily conceived by one of ordinary skill in the art, and additional or alternative base modifications are described elsewhere herein.

TABLE 3

MODIFIED SEQUENCES FOR ADDITIONAL 19-MERS

| Position | SEQ ID NO | Sense 5'-3' modified | SEQ ID NO | Antisense 5'-3' modified |
|---|---|---|---|---|
| 201 | 1025 | GGGcccAGcAAcGucccGGdTdT | 1537 | CCGGGACGUUGCUGGGCCCdTdT |
| 202 | 1026 | GGcccAGcAAcGucccGGcdTdT | 1538 | GCCGGGACGUUGCUGGGCCdTdT |
| 203 | 1027 | GcccAGcAAcGucccGGccdTdT | 1539 | GGCCGGGACGUUGCUGGGCdTdT |
| 204 | 1028 | cccAGcAAcGucccGGccudTdT | 1540 | AGGCCGGGACGUUGCUGGGdTdT |
| 205 | 1029 | ccAGcAAcGucccGGccuudTdT | 1541 | AAGGCCGGGACGUUGCUGGdTdT |
| 206 | 1030 | cAGcAAcGucccGGccuucdTdT | 1542 | GAAGGCCGGGACGUUGCUGdTdT |
| 207 | 1031 | AGcAAcGucccGGccuuccdTdT | 1543 | GGAAGGCCGGGACGUUGCUdTdT |
| 208 | 1032 | GcAAcGucccGGccuuccudTdT | 1544 | AGGAAGGCCGGGACGUUGCdTdT |
| 248 | 1070 | GAGcGAcccGGAcAccGAcdTdT | 1582 | GUCGGUGUCCGGGUCGCUCdTdT |
| 249 | 1071 | AGcGAcccGGAcAccGAcGdTdT | 1583 | CGUCGGUGUCCGGGUCGCUdTdT |
| 250 | 1072 | GcGAcccGGAcAccGAcGcdTdT | 1584 | GCGUCGGUGUCCGGGUCGCdTdT |
| 308 | 1077 | GuucGAccAGGGccAGuuudTdT | 1589 | AAACUGGCCCUGGUCGAACdTdT |
| 437 | 1118 | GGucAAGccAGAGAGAGAcdTdT | 1630 | GUCUCUCUCUGGCUUGACCdTdT |
| 438 | 1119 | GucAAGccAGAGAGAGAcGdTdT | 1631 | CGUCUCUCUCUGGCUUGAdTdT |
| 439 | 1120 | ucAAGccAGAGAGAGAcGAdTdT | 1632 | UCGUCUCUCUCUGGCUUGAdTdT |
| 440 | 1121 | cAAGccAGAGAGAGAcGAcdTdT | 1633 | GUCGUCUCUCUCUGGCUUGdTdT |
| 441 | 1122 | AAGccAGAGAGAGAcGAcAdTdT | 1634 | UGUCGUCUCUCUCUGGCUUdTdT |
| 442 | 1123 | AGccAGAGAGAGAcGAcAcdTdT | 1635 | GUGUCGUCUCUCUCUGGCUdTdT |
| 443 | 1124 | GccAGAGAGAGAcGAcAcGdTdT | 1636 | CGUGUCGUCUCUCUCUGGCdTdT |
| 444 | 1125 | ccAGAGAGAGAcGAcAcGGdTdT | 1637 | CCGUGUCGUCUCUCUCUGGdTdT |
| 445 | 1126 | cAGAGAGAGAcGAcAcGGAdTdT | 1638 | UCCGUGUCGUGUCUCUCUGdTdT |
| 446 | 1127 | AGAGAGAGAcGAcAcGGAGdTdT | 1639 | CUCCGUGUCGUCUCUCUCUdTdT |
| 447 | 1128 | GAGAGAGAcGAcAcGGAGudTdT | 1640 | ACUCCGUGUCGUCUCUCUCdTdT |
| 448 | 1129 | AGAGAGAcGAcAcGGAGuudTdT | 1641 | AACUCCGUGUCGUCUCUCUdTdT |
| 449 | 1130 | GAGAGAcGAcAcGGAGuucdTdT | 1642 | GAACUCCGUGUCGUCUCUCdTdT |
| 450 | 1131 | AGAGAcGAcAcGGAGuuccdTdT | 1643 | GGAACUCCGUGUCGUCUCUdTdT |
| 451 | 1132 | GAGAcGAcAcGGAGuuccAdTdT | 1644 | UGGAACUCCGUGUCGUCUCdTdT |

TABLE 3-continued

MODIFIED SEQUENCES FOR ADDITIONAL 19-MERS

| Position | SEQ ID NO | Sense 5'-3' modified | SEQ ID NO | Antisense 5'-3' modified |
|---|---|---|---|---|
| 452 | 1133 | AGAcGAcAcGGAGuuccAGdTdT | 1645 | CUGGAACUCCGUGUCGUCUdTdT |
| 453 | 1134 | GAcGAcAcGGAGuuccAGcdTdT | 1646 | GCUGGAACUCCGUGUCGUCdTdT |
| 454 | 1135 | AcGAcAcGGAGuuccAGcAdTdT | 1647 | UGCUGGAACUCCGUGUCGUdTdT |
| 455 | 1136 | cGAcAcGGAGuuccAGcAcdTdT | 1648 | GUGCUGGAACUCCGUGUCGdTdT |
| 456 | 1137 | GAcAcGGAGuuccAGcAccdTdT | 1649 | GGUGCUGGAACUCCGUGUCdTdT |
| 457 | 1138 | AcAcGGAGuuccAGcAcccdTdT | 1650 | GGGUGCUGGAACUCCGUGUdTdT |
| 507 | 1157 | GAGAAcAucAAGAGGAAAGdTdT | 1669 | CUUUCCUCUUGAUGUUCUCdTdT |
| 508 | 1158 | AGAAcAucAAGAGGAAAGudTdT | 1670 | ACUUUCCUCUUGAUGUUCUdTdT |
| 686 | 1246 | GGccAGccuucGGcAGAAGdTdT | 1758 | CUUCUGCCGAAGGCUGGCCdTdT |
| 687 | 1247 | GccAGccuucGGcAGAAGcdTdT | 1759 | GCUUCUGCCGAAGGCUGGCdTdT |
| 688 | 1248 | ccAGccuucGGcAGAAGcAdTdT | 1760 | UGCUUCUGCCGAAGGCUGGdTdT |
| 689 | 1249 | cAGccuucGGcAGAAGcAudTdT | 1761 | AUGCUUCUGCCGAAGGCUGdTdT |
| 708 | 1268 | GcccAGcAAcAGAAAGucGdTdT | 1780 | CGACUUUCUGUUGCUGGGCdTdT |
| 709 | 1269 | cccAGcAAcAGAAAGucGudTdT | 1781 | ACGACUUUCUGUUGCUGGGdTdT |
| 710 | 1270 | ccAGcAAcAGAAAGucGucdTdT | 1782 | GACGACUUUCUGUUGCUGGdTdT |
| 711 | 1271 | cAGcAAcAGAAAGucGucAdTdT | 1783 | UGACGACUUUCUGUUGCUGdTdT |
| 712 | 1272 | AGcAAcAGAAAGucGucAAdTdT | 1784 | UUGACGACUUUCUGUUGCUdTdT |
| 713 | 1273 | GcAAcAGAAAGucGucAAcdTdT | 1785 | GUUGACGACUUUCUGUUGCdTdT |
| 714 | 1274 | cAAcAGAAAGucGucAAcAdTdT | 1786 | UGUUGACGACUUUCUGUUGdTdT |
| 715 | 1275 | AAcAGAAAGucGucAAcAAdTdT | 1787 | UUGUUGACGACUUUCUGUUdTdT |
| 716 | 1276 | AcAGAAAGucGucAAcAAGdTdT | 1788 | CUUGUUGACGACUUUCUGUdTdT |
| 717 | 1277 | cAGAAAGucGucAAcAAGcdTdT | 1789 | GCUUGUUGACGACUUUCUGdTdT |
| 718 | 1278 | AGAAAGucGucAAcAAGcudTdT | 1790 | AGCUUGUUGACGACUUUCUdTdT |
| 719 | 1279 | GAAAGucGucAAcAAGcucdTdT | 1791 | GAGCUUGUUGACGACUUUCdTdT |
| 720 | 1280 | AAAGucGucAAcAAGcucAdTdT | 1792 | UGAGCUUGUUGACGACUUUdTdT |
| 721 | 1281 | AAGucGucAAcAAGcucAudTdT | 1793 | AUGAGCUUGUUGACGACUUdTdT |
| 722 | 1282 | AGucGucAAcAAGcucAuudTdT | 1794 | AAUGAGCUUGUUGACGACUdTdT |
| 723 | 1283 | GucGucAAcAAGcucAuucdTdT | 1795 | GAAUGAGCUUGUUGACGACdTdT |
| 724 | 1284 | ucGucAAcAAGcucAuucAdTdT | 1796 | UGAAUGAGCUUGUUGACGAdTdT |
| 725 | 1285 | cGucAAcAAGcucAuucAGdTdT | 1797 | CUGAAUGAGCUUGUUGACGdTdT |
| 726 | 1286 | GucAAcAAGcucAuucAGudTdT | 1798 | ACUGAAUGAGCUUGUUGACdTdT |
| 727 | 1287 | ucAAcAAGcucAuucAGuudTdT | 1799 | AACUGAAUGAGCUUGUUGAdTdT |
| 728 | 1288 | cAAcAAGcucAuucAGuucdTdT | 1800 | GAACUGAAUGAGCUUGUUGdTdT |
| 729 | 1289 | AAcAAGcucAuucAGuuccdTdT | 1801 | GGAACUGAAUGAGCUUGUUdTdT |
| 730 | 1290 | AcAAGcucAuucAGuuccudTdT | 1802 | AGGAACUGAAUGAGCUUGUdTdT |
| 863 | 1367 | GGAGcAcGuccAcGGcucGdTdT | 1879 | CGAGCCGUGGACCUGCUCCdTdT |
| 864 | 1368 | GAGcAcGuccAcGGcucGGdTdT | 1880 | CCGAGCCGUGGACGUGCUCdTdT |

TABLE 3-continued

MODIFIED SEQUENCES FOR ADDITIONAL 19-MERS

| Position | SEQ ID NO | Sense 5'-3' modified | SEQ ID NO | Antisense 5'-3' modified |
|---|---|---|---|---|
| 865 | 1369 | AGcAcGuccAcGGcucGGGdTdT | 1881 | CCCGAGCCGUGGACGUGCUdTdT |
| 866 | 1370 | GcAcGuccAcGGcucGGGcdTdT | 1882 | GCCCGAGCCGUGGACGUGCdTdT |
| 867 | 1371 | cAcGuccAcGGcucGGGccdTdT | 1883 | GGCCCGAGCCGUGGACGUGdTdT |
| 868 | 1372 | AcGuccAcGGcucGGGcccdTdT | 1884 | GGGCCCGAGCCGUGGACGUdTdT |
| 954 | 1374 | GGAcccAucAucuccGAcAdTdT | 1886 | UGUCGGAGAUGAUGGGUCCdTdT |
| 955 | 1375 | GAGccAucAucuccGAcAudTdT | 1887 | AUGUCGGAGAUGAUGGGUCdTdT |
| 956 | 1376 | AcccAucAucuccGAcAucdTdT | 1888 | GAUGUCGGAGAUGAUGGGUdTdT |
| 957 | 1377 | cccAucAucuccGAcAucAdTdT | 1889 | UGAUGUCGGAGAUGAUGGGdTdT |
| 958 | 1378 | ccAucAucuccGAcAucAcdTdT | 1890 | GUGAUGUCGGAGAUGAUGGdTdT |
| 959 | 1379 | cAucAucuccGAcAucAccdTdT | 1891 | GGUGAUGUCGGAGAUGAUGdTdT |
| 960 | 1380 | AucAucuccGAcAucAccGdTdT | 1892 | CGGUGAUGUCGGAGAUGAUdTdT |
| 961 | 1381 | ucAucuccGAcAucAccGAdTdT | 1893 | UCGGUGAUGUCGGAGAUGAdTdT |
| 962 | 1382 | cAucuccGAcAucAccGAGdTdT | 1894 | CUCGGUGAUGUCGGAGAUGdTdT |
| 963 | 1383 | AucuccGAcAucAccGAGcdTdT | 1895 | GCUCGGUGAUGUCGGAGAUdTdT |
| 964 | 1384 | ucuccGAcAucAccGAGcudTdT | 1896 | AGCUCGGUGAUGUCGGAGAdTdT |
| 1074 | 1414 | cccAGcccGccucAGAGccdTdT | 1926 | GGCUCUGAGGCGGGCUGGGdTdT |
| 1075 | 1415 | ccAGcccGccucAGAGcccdTdT | 1927 | GGGCUCUGAGGCGGGCUGGdTdT |
| 1376 | 1443 | GAGcAGccAcGGcuucAGcdTdT | 1955 | GCUGAAGCCGUGGCUGCUCdTdT |
| 1377 | 1444 | AGcAGccAcGGcuucAGcGdTdT | 1956 | CGCUGAAGCCGUGGCUGCUdTdT |
| 1378 | 1445 | GcAGccAcGGcuucAGcGudTdT | 1957 | ACGCUGAAGCCGUGGCUGCdTdT |
| 1533 | 1501 | GAGAAcAGcAGcccGGAuudTdT | 2013 | AAUCCGGGCUGCUGUUCUCdTdT |
| 1534 | 1502 | AGAAcAGcAGcccGGAuucdTdT | 2014 | GAAUCCGGGCUGCUGUUCUdTdT |
| 1535 | 1503 | GAAcAGcAGcccGGAuucAdTdT | 2015 | UGAAUCCGGGCUGCUGUUCdTdT |
| 1536 | 1504 | AAcAGcAGcccGGAuucAGdTdT | 2016 | CUGAAUCCGGGCUGCUGUUdTdT |
| 1537 | 1505 | AcAGcAGcccGGAuucAGGdTdT | 2017 | CCUGAAUCCGGGCUGCUGUdTdT |
| 1538 | 1506 | cAGcAGcccGGAuucAGGGdTdT | 2018 | CCCUGAAUCCGGGCUGCUGdTdT |
| 1539 | 1507 | AGcAGcccGGAuucAGGGAdTdT | 2019 | UCCCUGAAUCCGGGCUGCUdTdT |
| 1540 | 1508 | GcAGcccGGAuucAGGGAAdTdT | 2020 | UUCCCUGAAUCCGGGCUGCdTdT |
| 1541 | 1509 | cAGcccGGAuucAGGGAAGdTdT | 2021 | CUUCCCUGAAUCCGGGCUGdTdT |
| 1542 | 1510 | AGcccGGAuucAGGGAAGcdTdT | 2022 | GCUUCCCUGAAUCCGGGCUdTdT |
| 1543 | 1511 | GcccGGAuucAGGGAAGcAdTdT | 2023 | UGCUUCCCUGAAUCCGGGCdTdT |
| 1544 | 1512 | cccGGAuucAGGGAAGcAGdTdT | 2024 | CUGCUUCCCUGAAUCCGGGdTdT |
| 1545 | 1513 | ccGGAuucAGGGAAGcAGcdTdT | 2025 | GCUGCUUCCCUGAAUCCGGdTdT |
| 1546 | 1514 | cGGAuucAGGGAAGcAGcudTdT | 2026 | AGCUGCUUCCCUGAAUCCGdTdT |
| 1725 | 1532 | GAGccucccAAAGccAAGGdTdT | 3284 | CCUUGGCUUUGGGAGGCUCdTdT |
| 1726 | 1533 | AGccucccAAAGccAAGGAdTdT | 3285 | UCCUUGGCUUUGGGAGGCUdTdT |
| 1727 | 1534 | GccucccAAAGccAAGGAcdTdT | 3286 | GUCCUUGGCUUUGGGAGGCdTdT |

TABLE 3-continued

MODIFIED SEQUENCES FOR ADDITIONAL 19-MERS

| Position | SEQ ID NO | Sense 5'-3' modified | SEQ ID NO | Antisense 5'-3' modified |
|---|---|---|---|---|
| 1728 | 1535 | ccucccAAAGccAAGGAccdTdT | 3287 | GGUCCUUGGCUUUGGGAGGdTdT |
| 1729 | 1536 | cucccAAAGccAAGGAcccdTdT | 3288 | GGGUCCUUGGCUUUGGGAGdTdT |

Example 1A

Overlapping siRNAs

Some of the siRNAs listed above overlap each other in sequence. The following table presents a compilation of groups of RNAi agents, wherein each member of a group overlaps with each other member of the same group by at least 12 nt. A 12-nt portion of the overlap of the sense strands and a 12-nt portion of the overlap of the antisense strand are presented. Thus, for example, AD-20296 and AD-20300 share the common technical feature of the sequence of CCAAGCUGUGGA nucleotides 5-16 of SEQ ID NO: 1047 in the sense strand, and the sequence of UCCACAGCUUGG nucleotides 8-19 of SEQ ID NO: 1563 in the antisense strand. Note of course that only a 12-nt portion of the overlap is shown; many groups of RNAi agents will overlap by more than 12 nt. The position within the gene is also indicated.

TABLE 3A

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 210 | ACGUCCCGGCCU | 2097 | AGGCCGGGACGU | 2646 | AD-20594, AD-20596 |
| 211 | CGUCCCGGCCUU | 2098 | AAGGCCGGGACG | 2647 | AD-20594, AD-20285 |
| 212 | GUCCCGGCCUUC | 2099 | GAAGGCCGGGAC | 2648 | AD-20594, AD-20285 |
| 213 | UCCCGGCCUUCC | 2100 | GGAAGGCCGGGA | 2649 | AD-20594, AD-20285 |
| 214 | CCCGGCCUUCCU | 2101 | AGGAAGGCCGGG | 2650 | AD-20594, AD-20598 |
| 215 | CCGGCCUUCCUG | 2102 | CAGGAAGGCCGG | 2651 | AD-20594, AD-20598 |
| 216 | CGGCCUUCCUGA | 2103 | UCAGGAAGGCCG | 2652 | AD-20598, AD-20288 |
| 217 | GGCCUUCCUGAC | 2104 | GUCAGGAAGGCC | 2653 | AD-20289, AD-20598 |
| 218 | GCCUUCCUGACC | 2105 | GGUCAGGAAGGC | 2654 | AD-20290, AD-20598 |
| 219 | CCUUCCUGACCA | 2106 | UGGUCAGGAAGG | 2655 | AD-20290, AD-20598 |
| 220 | CUUCCUGACCAA | 2107 | UUGGUCAGGAAG | 2656 | AD-20290, AD-20598 |
| 221 | UUCCUGACCAAG | 2108 | CUUGGUCAGGAA | 2657 | AD-20290, AD-20598 |
| 222 | UCCUGACCAAGC | 2109 | GCUUGGUCAGGA | 2658 | AD-20290, AD-20294 |
| 223 | CCUGACCAAGCU | 2110 | AGCUUGGUCAGG | 2659 | AD-20290, AD-20295 |
| 224 | CUGACCAAGCUG | 2111 | CAGCUUGGUCAG | 2660 | AD-20290, AD-20296 |
| 225 | UGACCAAGCUGU | 2112 | ACAGCUUGGUCA | 2661 | AD-20290, AD-20296 |
| 226 | GACCAAGCUGUG | 2113 | CACAGCUUGGUC | 2662 | AD-20297, AD-20296 |
| 227 | ACCAAGCUGUGG | 2114 | CCACAGCUUGGU | 2663 | AD-20296, AD-20299 |
| 228 | CCAAGCUGUGGA | 2115 | UCCACAGCUUGG | 2664 | AD-20300, AD-20296 |
| 229 | CAAGCUGUGGAC | 2116 | GUCCACAGCUUG | 2665 | AD-20300, AD-20296 |
| 230 | AAGCUGUGGACC | 2117 | GGUCCACAGCUU | 2666 | AD-20300, AD-20296 |
| 231 | AGCUGUGGACCC | 2118 | GGGUCCACAGCU | 2667 | AD-20303, AD-20300, AD-20296 |
| 232 | GCUGUGGACCCU | 2119 | AGGGUCCACAGC | 2668 | AD-20303, AD-20300 |
| 233 | CUGUGGACCCUC | 2120 | GAGGGUCCACAG | 2669 | AD-20303, AD-20300 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 234 | UGUGGACCCUCG | 2121 | CGAGGGUCCACA | 2670 | AD-20303, AD-20300 |
| 235 | GUGGACCCUCGU | 2122 | ACGAGGGUCCAC | 2671 | AD-20303, AD-20300 |
| 236 | UGGACCCUCGUG | 2123 | CACGAGGGUCCA | 2672 | AD-20303, AD-20308 |
| 237 | GGACCCUCGUGA | 2124 | UCACGAGGGUCC | 2673 | AD-20303, AD-20308 |
| 238 | GACCCUCGUGAG | 2125 | CUCACGAGGGUC | 2674 | AD-20303, AD-20310 |
| 239 | ACCCUCGUGAGC | 2126 | GCUCACGAGGGU | 2675 | AD-20310, AD-20311 |
| 240 | CCCUCGUGAGCG | 2127 | CGCUCACGAGGG | 2676 | AD-20310, AD-20312 |
| 241 | CCUCGUGAGCGA | 2128 | UCGCUCACGAGG | 2677 | AD-20313, AD-20312 |
| 242 | CUCGUGAGCGAC | 2129 | GUCGCUCACGAG | 2678 | AD-20313, AD-20312 |
| 243 | UCGUGAGCGACC | 2130 | GGUCGCUCACGA | 2679 | AD-20315, AD-20313, AD-20312 |
| 244 | CGUGAGCGACCC | 2131 | GGGUCGCUCACG | 2680 | AD-20315, AD-20313, AD-20312 |
| 245 | GUGAGCGACCCG | 2132 | CGGGUCGCUCAC | 2681 | AD-20315, AD-20313, AD-20312 |
| 246 | UGAGCGACCCGG | 2133 | CCGGGUCGCUCA | 2682 | AD-20315, AD-20313, AD-20312 |
| 247 | GAGCGACCCGGA | 2134 | UCCGGGUCGCUC | 2683 | AD-20315, AD-20313, AD-20312 |
| 248 | AGCGACCCGGAC | 2135 | GUCCGGGUCGCU | 2684 | AD-20315, AD-20313 |
| 249 | GCGACCCGGACA | 2136 | UGUCCGGGUCGC | 2685 | AD-20315, AD-20318 |
| 250 | CGACCCGGACAC | 2137 | GUGUCCGGGUCG | 2686 | AD-20315, AD-20318 |
| 251 | GACCCGGACACC | 2138 | GGUGUCCGGGUC | 2687 | AD-20318, AD-20317 |
| 252 | ACCCGGACACCG | 2139 | CGGUGUCCGGGU | 2688 | AD-20318, AD-20317 |
| 270 | UCAUCUGCUGGA | 2140 | UCCAGCAGAUGA | 2689 | AD-20319, AD-20320 |
| 271 | CAUCUGCUGGAG | 2141 | CUCCAGCAGAUG | 2690 | AD-20319, AD-20320 |
| 272 | AUCUGCUGGAGC | 2142 | GCUCCAGCAGAU | 2691 | AD-20319, AD-20320 |
| 273 | UCUGCUGGAGCC | 2143 | GGCUCCAGCAGA | 2692 | AD-20319, AD-20320 |
| 274 | CUGCUGGAGCCC | 2144 | GGGCUCCAGCAG | 2693 | AD-20319, AD-20320 |
| 275 | UGCUGGAGCCCG | 2145 | CGGGCUCCAGCA | 2694 | AD-20319, AD-20320 |
| 276 | GCUGGAGCCCGA | 2146 | UCGGGCUCCAGC | 2695 | AD-20319, AD-20320 |
| 306 | UGUUCGACCAGG | 2147 | CCUGGUCGAACA | 2696 | AD-20345, AD-20344 |
| 307 | GUUCGACCAGGG | 2148 | CCCUGGUCGAAC | 2697 | AD-20345, AD-20344 |
| 308 | UUCGACCAGGGC | 2149 | GCCCUGGUCGAA | 2698 | AD-20345, AD-20344 |
| 309 | UCGACCAGGGCC | 2150 | GGCCCUGGUCGA | 2699 | AD-20345, AD-20344 |
| 310 | CGACCAGGGCCA | 2151 | UGGCCCUGGUCG | 2700 | AD-20345, AD-20348, AD-20344 |
| 311 | GACCAGGGCCAG | 2152 | CUGGCCCUGGUC | 2701 | AD-20349, AD-20345, AD-20348, AD-20344 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 312 | ACCAGGGCCAGU | 2153 | ACUGGCCCUGGU | 2702 | AD-20349, AD-20345, AD-20348, AD-20344 |
| 313 | CCAGGGCCAGUU | 2154 | AACUGGCCCUGG | 2703 | AD-20349, AD-20345, AD-20348 |
| 314 | CAGGGCCAGUUU | 2155 | AAACUGGCCCUG | 2704 | AD-20349, AD-20348 |
| 315 | AGGGCCAGUUUG | 2156 | CAAACUGGCCCU | 2705 | AD-20349, AD-20353, AD-20348 |
| 316 | GGGCCAGUUUGC | 2157 | GCAAACUGGCCC | 2706 | AD-20349, AD-20353, AD-20348 |
| 317 | GGCCAGUUUGCC | 2158 | GGCAAACUGGCC | 2707 | AD-20349, AD-20353, AD-20348 |
| 318 | GCCAGUUUGCCA | 2159 | UGGCAAACUGGC | 2708 | AD-20349, AD-20353 |
| 319 | CCAGUUUGCCAA | 2160 | UUGGCAAACUGG | 2709 | AD-20353, AD-20356 |
| 320 | CAGUUUGCCAAG | 2161 | CUUGGCAAACUG | 2710 | AD-20353, AD-20358 |
| 321 | AGUUUGCCAAGG | 2162 | CCUUGGCAAACU | 2711 | AD-20353, AD-20359 |
| 322 | GUUUGCCAAGGA | 2163 | UCCUUGGCAAAC | 2712 | AD-20353, AD-20360 |
| 323 | UUUGCCAAGGAG | 2164 | CUCCUUGGCAAA | 2713 | AD-20361, AD-20360 |
| 324 | UUGCCAAGGAGG | 2165 | CCUCCUUGGCAA | 2714 | AD-20362, AD-20360 |
| 325 | UGCCAAGGAGGU | 2166 | ACCUCCUUGGCA | 2715 | AD-20362, AD-20360 |
| 326 | GCCAAGGAGGUG | 2167 | CACCUCCUUGGC | 2716 | AD-20364, AD-20362 |
| 327 | CCAAGGAGGUGC | 2168 | GCACCUCCUUGG | 2717 | AD-20365, AD-20364, AD-20362 |
| 328 | CAAGGAGGUGCU | 2169 | AGCACCUCCUUG | 2718 | AD-20365, AD-20366, AD-20364, AD-20362 |
| 329 | AAGGAGGUGCUG | 2170 | CAGCACCUCCUU | 2719 | AD-20365, AD-20366, AD-20364, AD-20362 |
| 330 | AGGAGGUGCUGC | 2171 | GCAGCACCUCCU | 2720 | AD-20365, AD-20366, AD-20364, AD-20362 |
| 331 | GGAGGUGCUGCC | 2172 | GGCAGCACCUCC | 2721 | AD-20365, AD-20366, AD-20364, AD-20362 |
| 332 | GAGGUGCUGCCC | 2173 | GGGCAGCACCUC | 2722 | AD-20365, AD-20366, AD-20364 |
| 333 | AGGUGCUGCCCA | 2174 | UGGGCAGCACCU | 2723 | AD-20365, AD-20366, AD-20364 |
| 334 | GGUGCUGCCCAA | 2175 | UUGGGCAGCACC | 2724 | AD-20365, AD-20366 |
| 335 | GUGCUGCCCAAG | 2176 | CUUGGGCAGCAC | 2725 | AD-20366, AD-20367 |
| 336 | UGCUGCCCAAGU | 2177 | ACUUGGGCAGCA | 2726 | AD-20368, AD-20367 |
| 341 | CCCAAGUACUUC | 2178 | GAAGUACUUGGG | 2727 | AD-20282, AD-20281 |
| 342 | CCAAGUACUUCA | 2179 | UGAAGUACUUGG | 2728 | AD-20282, AD-20281 |
| 343 | CAAGUACUUCAA | 2180 | UUGAAGUACUUG | 2729 | AD-20282, AD-20281 |
| 344 | AAGUACUUCAAG | 2181 | CUUGAAGUACUU | 2730 | AD-20282, AD-20281 |
| 345 | AGUACUUCAAGC | 2182 | GCUUGAAGUACU | 2731 | AD-20282, AD-20281 |
| 346 | GUACUUCAAGCA | 2183 | UGCUUGAAGUAC | 2732 | AD-20282, AD-20281 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 347 | UACUUCAAGCAC | 2184 | GUGCUUGAAGUA | 2733 | AD-20282, AD-20281 |
| 348 | ACUUCAAGCACA | 2185 | UGUGCUUGAAGU | 2734 | AD-20282, AD-20283 |
| 351 | UCAAGCACAACA | 2186 | UGUUGUGCUUGA | 2735 | AD-20369, AD-20370 |
| 352 | CAAGCACAACAA | 2187 | UUGUUGUGCUUG | 2736 | AD-20369, AD-20370 |
| 353 | AAGCACAACAAC | 2188 | GUUGUUGUGCUU | 2737 | AD-20369, AD-20370 |
| 354 | AGCACAACAACA | 2189 | UGUUGUUGUGCU | 2738 | AD-20373, AD-20369 |
| 355 | GCACAACAACAU | 2190 | AUGUUGUUGUGC | 2739 | AD-20373, AD-20374 |
| 356 | CACAACAACAUG | 2191 | CAUGUUGUUGUG | 2740 | AD-20373, AD-20374 |
| 357 | ACAACAACAUGG | 2192 | CCAUGUUGUUGU | 2741 | AD-20373, AD-20374, AD-20376 |
| 358 | CAACAACAUGGC | 2193 | GCCAUGUUGUUG | 2742 | AD-20373, AD-20376 |
| 359 | AACAACAUGGCC | 2194 | GGCCAUGUUGUU | 2743 | AD-20373, AD-20374, AD-20376, AD-20378 |
| 360 | ACAACAUGGCCA | 2195 | UGGCCAUGUUGU | 2744 | AD-20373, AD-20374, AD-20376, AD-20378 |
| 361 | CAACAUGGCCAG | 2196 | CUGGCCAUGUUG | 2745 | AD-20373, AD-20374, AD-20376, AD-20378, AD-20380 |
| 362 | AACAUGGCCAGC | 2197 | GCUGGCCAUGUU | 2746 | AD-20374, AD-20376, AD-20378, AD-20380 |
| 363 | ACAUGGCCAGCU | 2198 | AGCUGGCCAUGU | 2747 | AD-20376, AD-20378, AD-20380 |
| 364 | CAUGGCCAGCUU | 2199 | AAGCUGGCCAUG | 2748 | AD-20376, AD-20378, AD-20380 |
| 365 | AUGGCCAGCUUC | 2200 | GAAGCUGGCCAU | 2749 | AD-20378, AD-20380 |
| 366 | UGGCCAGCUUCG | 2201 | CGAAGCUGGCCA | 2750 | AD-20378, AD-20380 |
| 367 | GGCCAGCUUCGU | 2202 | ACGAAGCUGGCC | 2751 | AD-20380, AD-20385 |
| 368 | GCCAGCUUCGUG | 2203 | CACGAAGCUGGC | 2752 | AD-20380, AD-20385 |
| 369 | CCAGCUUCGUGC | 2204 | GCACGAAGCUGG | 2753 | AD-20382, AD-20385 |
| 370 | CAGCUUCGUGCG | 2205 | CGCACGAAGCUG | 2754 | AD-20382, AD-20385 |
| 371 | AGCUUCGUGCGG | 2206 | CCGCACGAAGCU | 2755 | AD-20384, AD-20385 |
| 372 | GCUUCGUGCGGC | 2207 | GCCGCACGAAGC | 2756 | AD-20384, AD-20385 |
| 489 | GCCAGGAGCAGC | 2208 | GCUGCUCCUGGC | 2757 | AD-20388, AD-20387 |
| 490 | CCAGGAGCAGCU | 2209 | AGCUGCUCCUGG | 2758 | AD-20388, AD-20387, AD-20389 |
| 491 | CAGGAGCAGCUC | 2210 | GAGCUGCUCCUG | 2759 | AD-20390, AD-20388, AD-20387, AD-20389 |
| 492 | AGGAGCAGCUCC | 2211 | GGAGCUGCUCCU | 2760 | AD-20390, AD-20391, AD-20388, AD-20387, AD-20389 |
| 493 | GGAGCAGCUCCU | 2212 | AGGAGCUGCUCC | 2761 | AD-20390, AD-20391, AD-20388, AD-20392, AD-20387, AD-20389 |

TABLE 3A-continued

| OVERLAPPING siRNAs | | | | |
|---|---|---|---|---|
| Position | Sense overlap | SEQ ID NO: | Antisense overlap | SEQ ID NO: | RNAi Agents that overlap by at least 12 nt with each other |

| Position | Sense overlap | SEQ ID NO: | Antisense overlap | SEQ ID NO: | RNAi Agents that overlap by at least 12 nt with each other |
|---|---|---|---|---|---|
| 494 | GAGCAGCUCCUU | 2213 | AAGGAGCUGCUC | 2762 | AD-20390, AD-20391, AD-20388, AD-20393, AD-20392, AD-20387, AD-20389 |
| 495 | AGCAGCUCCUUG | 2214 | CAAGGAGCUGCU | 2763 | AD-20390, AD-20391, AD-20388, AD-20393, AD-20392, AD-20387, AD-20389 |
| 496 | GCAGCUCCUUGA | 2215 | UCAAGGAGCUGC | 2764 | AD-20390, AD-20395, AD-20391, AD-20388, AD-20393, AD-20392, AD-20389 |
| 497 | CAGCUCCUUGAG | 2216 | CUCAAGGAGCUG | 2765 | AD-20390, AD-20395, AD-20396, AD-20391, AD-20393, AD-20392, AD-20389 |
| 498 | AGCUCCUUGAGA | 2217 | UCUCAAGGAGCU | 2766 | AD-20390, AD-20395, AD-20396, AD-20397, AD-20391, AD-20393, AD-20392 |
| 499 | GCUCCUUGAGAA | 2218 | UUCUCAAGGAGC | 2767 | AD-20395, AD-20396, AD-20398, AD-20397, AD-20391, AD-20393, AD-20392 |
| 500 | CUCCUUGAGAAC | 2219 | GUUCUCAAGGAG | 2768 | AD-20395, AD-20396, AD-20398, AD-20397, AD-20393, AD-20399, AD-20392 |
| 501 | UCCUUGAGAACA | 2220 | UGUUCUCAAGGA | 2769 | AD-20395, AD-20396, AD-20398, AD-20397, AD-20393, AD-20399 |
| 502 | CCUUGAGAACAU | 2221 | AUGUUCUCAAGG | 2770 | AD-20395, AD-20396, AD-20398, AD-20397, AD-20399, AD-20401 |
| 503 | CUUGAGAACAUC | 2222 | GAUGUUCUCAAG | 2771 | AD-20395, AD-20396, AD-20402, AD-20398, AD-20397, AD-20399, AD-20401 |
| 504 | UUGAGAACAUCA | 2223 | UGAUGUUCUCAA | 2772 | AD-20403, AD-20396, AD-20402, AD-20398, AD-20397, AD-20399, AD-20401 |
| 505 | UGAGAACAUCAA | 2224 | UUGAUGUUCUCA | 2773 | AD-20403, AD-20404, AD-20402, AD-20398, AD-20397, AD-20399, AD-20401 |
| 506 | GAGAACAUCAAG | 2225 | CUUGAUGUUCUC | 2774 | AD-20403, AD-20404, AD-20402, AD-20398, AD-20399, AD-20401 |
| 507 | AGAACAUCAAGA | 2226 | UCUUGAUGUUCU | 2775 | AD-20403, AD-20404, AD-20402, AD-20399, AD-20401 |
| 508 | GAACAUCAAGAG | 2227 | CUCUUGAUGUUC | 2776 | AD-20403, AD-20404, AD-20402, AD-20401 |
| 509 | AACAUCAAGAGG | 2228 | CCUCUUGAUGUU | 2777 | AD-20403, AD-20404, AD-20402, AD-20406, AD-20401 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 510 | ACAUCAAGAGGA | 2229 | UCCUCUUGAUGU | 2778 | AD-20403, AD-20404, AD-20402, AD-20406, AD-20407 |
| 511 | CAUCAAGAGGAA | 2230 | UUCCUCUUGAUG | 2779 | AD-20403, AD-20404, AD-20406, AD-20407, AD-20408 |
| 512 | AUCAAGAGGAAA | 2231 | UUUCCUCUUGAU | 2780 | AD-20409, AD-20404, AD-20406, AD-20407, AD-20408 |
| 513 | UCAAGAGGAAAG | 2232 | CUUUCCUCUUGA | 2781 | AD-20409, AD-20406, AD-20410, AD-20407, AD-20408 |
| 514 | CAAGAGGAAAGU | 2233 | ACUUUCCUCUUG | 2782 | AD-20409, AD-20406, AD-20410, AD-20407, AD-20408, AD-20411 |
| 515 | AAGAGGAAAGUG | 2234 | CACUUUCCUCUU | 2783 | AD-20409, AD-20406, AD-20410, AD-20407, AD-20408, AD-20411 |
| 516 | AGAGGAAAGUGA | 2235 | UCACUUUCCUCU | 2784 | AD-20409, AD-20406, AD-20410, AD-20407, AD-20408, AD-20413, AD-20411 |
| 517 | GAGGAAAGUGAC | 2236 | GUCACUUUCCUC | 2785 | AD-20409, AD-20410, AD-20407, AD-20408, AD-20413, AD-20411 |
| 518 | AGGAAAGUGACC | 2237 | GGUCACUUUCCU | 2786 | AD-20409, AD-20410, AD-20408, AD-20413, AD-20411 |
| 519 | GGAAAGUGACCA | 2238 | UGGUCACUUUCC | 2787 | AD-20409, AD-20410, AD-20413, AD-20411 |
| 520 | GAAAGUGACCAG | 2239 | CUGGUCACUUUC | 2788 | AD-20410, AD-20413, AD-20411 |
| 521 | AAAGUGACCAGU | 2240 | ACUGGUCACUUU | 2789 | AD-20413, AD-20411 |
| 522 | AAGUGACCAGUG | 2241 | CACUGGUCACUU | 2790 | AD-20413, AD-20412 |
| 523 | AGUGACCAGUGU | 2242 | ACACUGGUCACU | 2791 | AD-20420, AD-20413 |
| 524 | GUGACCAGUGUG | 2243 | CACACUGGUCAC | 2792 | AD-20420, AD-20421 |
| 525 | UGACCAGUGUGU | 2244 | ACACACUGGUCA | 2793 | AD-20421, AD-20422 |
| 526 | GACCAGUGUGUC | 2245 | GACACACUGGUC | 2794 | AD-20421, AD-20422 |
| 527 | ACCAGUGUGUCC | 2246 | GGACACACUGGU | 2795 | AD-20421, AD-20422 |
| 528 | CCAGUGUGUCCA | 2247 | UGGACACACUGG | 2796 | AD-20421, AD-20422 |
| 529 | CAGUGUGUCCAC | 2248 | GUGGACACACUG | 2797 | AD-20426, AD-20421, AD-20422, |
| 530 | AGUGUGUCCACC | 2249 | GGUGGACACACU | 2798 | AD-20427, AD-20426, AD-20421, AD-20422 |
| 531 | GUGUGUCCACCC | 2250 | GGGUGGACACAC | 2799 | AD-20427, AD-20426, AD-20421, AD-20422, AD-20428 |
| 532 | UGUGUCCACCCU | 2251 | AGGGUGGACACA | 2800 | AD-20427, AD-20426, AD-20422, AD-20428 |

TABLE 3A-continued

| OVERLAPPING siRNAs | | | | |
|---|---|---|---|---|
| Position Sense overlap | SEQ ID NO: | Antisense overlap | SEQ ID NO: | RNAi Agents that overlap by at least 12 nt with each other |
| 533 GUGUCCACCCUG | 2252 | CAGGGUGGACAC | 2801 | AD-20427, AD-20426, AD-20428 |
| 534 UGUCCACCCUGA | 2253 | UCAGGGUGGACA | 2802 | AD-20427, AD-20426, AD-20428 |
| 535 GUCCACCCUGAA | 2254 | UUCAGGGUGGAC | 2803 | AD-20427, AD-20426, AD-20428 |
| 536 UCCACCCUGAAG | 2255 | CUUCAGGGUGGA | 2804 | AD-20427, AD-20426, AD-20433, AD-20428 |
| 537 CCACCCUGAAGA | 2256 | UCUUCAGGGUGG | 2805 | AD-20434, AD-20427, AD-20433, AD-20428 |
| 538 CACCCUGAAGAG | 2257 | CUCUUCAGGGUG | 2806 | AD-20434, AD-20433, AD-20428, AD-20435 |
| 539 ACCCUGAAGAGU | 2258 | ACUCUUCAGGGU | 2807 | AD-20434, AD-20433, AD-20436, AD-20435 |
| 540 CCCUGAAGAGUG | 2259 | CACUCUUCAGGG | 2808 | AD-20434, AD-20433, AD-20436, AD-20437, AD-20435 |
| 541 CCUGAAGAGUGA | 2260 | UCACUCUUCAGG | 2809 | AD-20434, AD-20438, AD-20433, AD-20436, AD-20437, AD-20435 |
| 542 CUGAAGAGUGAA | 2261 | UUCACUCUUCAG | 2810 | AD-20439, AD-20434, AD-20438, AD-20433, AD-20436, AD-20437, AD-20435 |
| 543 UGAAGAGUGAAG | 2262 | CUUCACUCUUCA | 2811 | AD-20439, AD-20434, AD-20487, AD-20438, AD-20433, AD-20436, AD-20437, AD-20435 |
| 544 GAAGAGUGAAGA | 2263 | UCUUCACUCUUC | 2812 | AD-20439, AD-20434, AD-20487, AD-20488, AD-20438, AD-20436, AD-20437, AD-20435 |
| 545 AAGAGUGAAGAC | 2264 | GUCUUCACUCUU | 2813 | AD-20439, AD-20487, AD-20488, AD-20489, AD-20438, AD-20436, AD-20437, AD-20435 |
| 546 AGAGUGAAGACA | 2265 | UGUCUUCACUCU | 2814 | AD-20439, AD-20487, AD-20488, AD-20489, AD-20438, AD-20436, AD-20437, AD-20490 |
| 547 GAGUGAAGACAU | 2266 | AUGUCUUCACUC | 2815 | AD-20439, AD-20491, AD-20487, AD-20488, AD-20489, AD-20438, AD-20437, AD-20490 |
| 548 AGUGAAGACAUA | 2267 | UAUGUCUUCACU | 2816 | AD-20439, AD-20491, AD-20487, AD-20488, AD-20489, AD-20438, AD-20490 |
| 549 GUGAAGACAUAA | 2268 | UUAUGUCUUCAC | 2817 | AD-20439, AD-20491, AD-20487, AD-20488, AD-20489, AD-20493, AD-20490 |
| 550 UGAAGACAUAAA | 2269 | UUUAUGUCUUCA | 2818 | AD-20491, AD-20487, AD-20488, AD-20489, AD-20493, AD-20490 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 551 | GAAGACAUAAAG | 2270 | CUUUAUGUCUUC | 2819 | AD-20491, AD-20488, AD-20489, AD-20493, AD-20490 |
| 552 | AAGACAUAAAGA | 2271 | UCUUUAUGUCUU | 2820 | AD-20491, AD-20489, AD-20493, AD-20490 |
| 553 | AGACAUAAAGAU | 2272 | AUCUUUAUGUCU | 2821 | AD-20491, AD-20493, AD-20490 |
| 554 | GACAUAAAGAUC | 2273 | GAUCUUUAUGUC | 2822 | AD-20491, AD-20493 |
| 555 | ACAUAAAGAUCC | 2274 | GGAUCUUUAUGU | 2823 | AD-20492, AD-20493 |
| 579 | UCACCAAGCUGC | 2275 | GCAGCUUGGUGA | 2824 | AD-20494, AD-20495 |
| 580 | CACCAAGCUGCU | 2276 | AGCAGCUUGGUG | 2825 | AD-20494, AD-20495 |
| 581 | ACCAAGCUGCUG | 2277 | CAGCAGCUUGGU | 2826 | AD-20494, AD-20495 |
| 582 | CCAAGCUGCUGA | 2278 | UCAGCAGCUUGG | 2827 | AD-20494, AD-20495 |
| 583 | CAAGCUGCUGAC | 2279 | GUCAGCAGCUUG | 2828 | AD-20494, AD-20495 |
| 584 | AAGCUGCUGACG | 2280 | CGUCAGCAGCUU | 2829 | AD-20494, AD-20495 |
| 585 | AGCUGCUGACGG | 2281 | CCGUCAGCAGCU | 2830 | AD-20494, AD-20495, AD-20501 |
| 586 | GCUGCUGACGGA | 2282 | UCCGUCAGCAGC | 2831 | AD-20495, AD-20502, AD-20501 |
| 587 | CUGCUGACGGAC | 2283 | GUCCGUCAGCAG | 2832 | AD-20502, AD-20501 |
| 588 | UGCUGACGGACG | 2284 | CGUCCGUCAGCA | 2833 | AD-20504, AD-20502, AD-20501 |
| 589 | GCUGACGGACGU | 2285 | ACGUCCGUCAGC | 2834 | AD-20504, AD-20502, AD-20501 |
| 590 | CUGACGGACGUG | 2286 | CACGUCCGUCAG | 2835 | AD-20504, AD-20506, AD-20502, AD-20501 |
| 591 | UGACGGACGUGC | 2287 | GCACGUCCGUCA | 2836 | AD-20504, AD-20506, AD-20507, AD-20502, AD-20501 |
| 592 | GACGGACGUGCA | 2288 | UGCACGUCCGUC | 2837 | AD-20504, AD-20506, AD-20507, AD-20502, AD-20501 |
| 593 | ACGGACGUGCAG | 2289 | CUGCACGUCCGU | 2838 | AD-20504, AD-20506, AD-20507, AD-20502 |
| 594 | CGGACGUGCAGC | 2290 | GCUGCACGUCCG | 2839 | AD-20504, AD-20506, AD-20507, AD-20510 |
| 595 | GGACGUGCAGCU | 2291 | AGCUGCACGUCC | 2840 | AD-20511, AD-20504, AD-20506, AD-20507, AD-20510 |
| 596 | GACGUGCAGCUG | 2292 | CAGCUGCACGUC | 2841 | AD-20511, AD-20506, AD-20507, AD-20510 |
| 597 | ACGUGCAGCUGA | 2293 | UCAGCUGCACGU | 2842 | AD-20511, AD-20506, AD-20507, AD-20510, AD-20513 |
| 598 | CGUGCAGCUGAU | 2294 | AUCAGCUGCACG | 2843 | AD-20511, AD-20507, AD-20510, AD-20513 |
| 599 | GUGCAGCUGAUG | 2295 | CAUCAGCUGCAC | 2844 | AD-20511, AD-20510, AD-20513 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 600 | UGCAGCUGAUGA | 2296 | UCAUCAGCUGCA | 2845 | AD-20511, AD-20510, AD-20513 |
| 601 | GCAGCUGAUGAA | 2297 | UUCAUCAGCUGC | 2846 | AD-20511, AD-20510, AD-20513 |
| 602 | CAGCUGAUGAAG | 2298 | CUUCAUCAGCUG | 2847 | AD-20511, AD-20513 |
| 603 | AGCUGAUGAAGG | 2299 | CCUUCAUCAGCU | 2848 | AD-20512, AD-20513 |
| 660 | AGAAUGAGGCUC | 2300 | GAGCCUCAUUCU | 2849 | AD-20514, AD-20515 |
| 661 | GAAUGAGGCUCU | 2301 | AGAGCCUCAUUC | 2850 | AD-20516, AD-20515 |
| 662 | AAUGAGGCUCUG | 2302 | CAGAGCCUCAUU | 2851 | AD-20517, AD-20515 |
| 663 | AUGAGGCUCUGU | 2303 | ACAGAGCCUCAU | 2852 | AD-20518, AD-20515 |
| 664 | UGAGGCUCUGUG | 2304 | CACAGAGCCUCA | 2853 | AD-20519, AD-20515 |
| 665 | GAGGCUCUGUGG | 2305 | CCACAGAGCCUC | 2854 | AD-20520, AD-20515 |
| 666 | AGGCUCUGUGGC | 2306 | GCCACAGAGCCU | 2855 | AD-20521, AD-20515 |
| 667 | GGCUCUGUGGCG | 2307 | CGCCACAGAGCC | 2856 | AD-20521, AD-20522 |
| 668 | GCUCUGUGGCGG | 2308 | CCGCCACAGAGC | 2857 | AD-20523, AD-20522 |
| 669 | CUCUGUGGCGGG | 2309 | CCCGCCACAGAG | 2858 | AD-20524, AD-20523, |
| 670 | UCUGUGGCGGGA | 2310 | UCCCGCCACAGA | 2859 | AD-20524, AD-20525, |
| 671 | CUGUGGCGGGAG | 2311 | CUCCCGCCACAG | 2860 | AD-20524, AD-20525 |
| 672 | UGUGGCGGGAGG | 2312 | CCUCCCGCCACA | 2861 | AD-20527, AD-20524 |
| 673 | GUGGCGGGAGGU | 2313 | ACCUCCCGCCAC | 2862 | AD-20527, AD-20524 |
| 674 | UGGCGGGAGGUG | 2314 | CACCUCCCGCCA | 2863 | AD-20527, AD-20524 |
| 675 | GGCGGGAGGUGG | 2315 | CCACCUCCCGCC | 2864 | AD-20530, AD-20527 |
| 676 | GCGGGAGGUGGC | 2316 | GCCACCUCCCGC | 2865 | AD-20530, AD-20527 |
| 677 | CGGGAGGUGGCC | 2317 | GGCCACCUCCCG | 2866 | AD-20530, AD-20527 |
| 678 | GGGAGGUGGCCA | 2318 | UGGCCACCUCCC | 2867 | AD-20530, AD-20527 |
| 679 | GGAGGUGGCCAG | 2319 | CUGGCCACCUCC | 2868 | AD-20530, AD-20527 |
| 680 | GAGGUGGCCAGC | 2320 | GCUGGCCACCUC | 2869 | AD-20530, AD-20535 |
| 681 | AGGUGGCCAGCC | 2321 | GGCUGGCCACCU | 2870 | AD-20530, AD-20535 |
| 682 | GGUGGCCAGCCU | 2322 | AGGCUGGCCACC | 2871 | AD-20530, AD-20535 |
| 683 | GUGGCCAGCCUU | 2323 | AAGGCUGGCCAC | 2872 | AD-20532, AD-20535 |
| 684 | UGGCCAGCCUUC | 2324 | GAAGGCUGGCCA | 2873 | AD-20539, AD-20535 |
| 685 | GGCCAGCCUUCG | 2325 | CGAAGGCUGGCC | 2874 | AD-20539, AD-20535 |
| 686 | GCCAGCCUUCGG | 2326 | CCGAAGGCUGGC | 2875 | AD-20539, AD-20535 |
| 687 | CCAGCCUUCGGC | 2327 | GCCGAAGGCUGG | 2876 | AD-20539, AD-20535 |
| 688 | CAGCCUUCGGCA | 2328 | UGCCGAAGGCUG | 2877 | AD-20539, AD-20538 |
| 689 | AGCCUUCGGCAG | 2329 | CUGCCGAAGGCU | 2878 | AD-20539, AD-20540 |
| 690 | GCCUUCGGCAGA | 2330 | UCUGCCGAAGGC | 2879 | AD-20539, AD-20540 |

TABLE 3A-continued

| OVERLAPPING siRNAs | | | | |
|---|---|---|---|---|
| Position Sense overlap | SEQ ID NO: | Antisense overlap | SEQ ID NO: | RNAi Agents that overlap by at least 12 nt with each other |
| 691 CCUUCGGCAGAA | 2331 | UUCUGCCGAAGG | 2880 | AD-20539, AD-20540 |
| 692 CUUCGGCAGAAG | 2332 | CUUCUGCCGAAG | 2881 | AD-20541, AD-20540 |
| 693 UUCGGCAGAAGC | 2333 | GCUUCUGCCGAA | 2882 | AD-20544, AD-20540 |
| 694 UCGGCAGAAGCA | 2334 | UGCUUCUGCCGA | 2883 | AD-20544, AD-20545 |
| 695 CGGCAGAAGCAU | 2335 | AUGCUUCUGCCG | 2884 | AD-20546, AD-20544, AD-20545 |
| 696 GGCAGAAGCAUG | 2336 | CAUGCUUCUGCC | 2885 | AD-20546, AD-20544, AD-20545, AD-20547 |
| 697 GCAGAAGCAUGC | 2337 | GCAUGCUUCUGC | 2886 | AD-20546, AD-20544, AD-20545, AD-20548, AD-20547 |
| 698 CAGAAGCAUGCC | 2338 | GGCAUGCUUCUG | 2887 | AD-20546, AD-20544, AD-20545, AD-20549, AD-20548, AD-20547 |
| 699 AGAAGCAUGCCC | 2339 | GGGCAUGCUUCU | 2888 | AD-20546, AD-20544, AD-20545, AD-20549, AD-20548, AD-20547 |
| 700 GAAGCAUGCCCA | 2340 | UGGGCAUGCUUC | 2889 | AD-20546, AD-20544, AD-20545, AD-20549, AD-20548, AD-20547 |
| 701 AAGCAUGCCCAG | 2341 | CUGGGCAUGCUU | 2890 | AD-20546, AD-20552, AD-20545, AD-20549, AD-20548, AD-20547 |
| 702 AGCAUGCCCAGC | 2342 | GCUGGGCAUGCU | 2891 | AD-20546, AD-20552, AD-20549, AD-20548, AD-20547 |
| 703 GCAUGCCCAGCA | 2343 | UGCUGGGCAUGC | 2892 | AD-20552, AD-20549, AD-20548, AD-20547 |
| 704 CAUGCCCAGCAA | 2344 | UUGCUGGGCAUG | 2893 | AD-20552, AD-20555, AD-20549, AD-20548 |
| 705 AUGCCCAGCAAC | 2345 | GUUGCUGGGCAU | 2894 | AD-20556, AD-20552, AD-20555, AD-20549 |
| 706 UGCCCAGCAACA | 2346 | UGUUGCUGGGCA | 2895 | AD-20557, AD-20556, AD-20552, AD-20555 |
| 707 GCCCAGCAACAG | 2347 | CUGUUGCUGGGC | 2896 | AD-20557, AD-20556, AD-20552, AD-20555 |
| 708 CCCAGCAACAGA | 2348 | UCUGUUGCUGGG | 2897 | AD-20557, AD-20556, AD-20552, AD-20555 |
| 709 CCAGCAACAGAA | 2349 | UUCUGUUGCUGG | 2898 | AD-20557, AD-20556, AD-20555 |
| 710 CAGCAACAGAAA | 2350 | UUUCUGUUGCUG | 2899 | AD-20557, AD-20556, AD-20555 |
| 711 AGCAACAGAAAG | 2351 | CUUUCUGUUGCU | 2900 | AD-20557, AD-20556, AD-20555 |
| 712 GCAACAGAAAGU | 2352 | ACUUUCUGUUGC | 2901 | AD-20557, AD-20556 |
| 731 AAGCUCAUUCAG | 2353 | CUGAAUGAGCUU | 2902 | AD-20559, AD-20558 |
| 732 AGCUCAUUCAGU | 2354 | ACUGAAUGAGCU | 2903 | AD-20559, AD-20558, AD-20560 |

TABLE 3A-continued

OVERLAPPING siRNAs

| Posi-tion | Sense overlap | SEQ ID NO: | Antisense overlap | SEQ ID NO: | RNAi Agents that overlap by at least 12 nt with each other |
|---|---|---|---|---|---|
| 733 | GCUCAUUCAGUU | 2355 | AACUGAAUGAGC | 2904 | AD-20559, AD-20558, AD-20560, AD-20561 |
| 734 | CUCAUUCAGUUC | 2356 | GAACUGAAUGAG | 2905 | AD-20562, AD-20559, AD-20558, AD-20560, AD-20561 |
| 735 | UCAUUCAGUUCC | 2357 | GGAACUGAAUGA | 2906 | AD-20562, AD-20559, AD-20563, AD-20558, AD-20560, AD-20561 |
| 736 | CAUUCAGUUCCU | 2358 | AGGAACUGAAUG | 2907 | AD-20562, AD-20559, AD-20563, AD-20558, AD-20560, AD-20564, AD-20561 |
| 737 | AUUCAGUUCCUG | 2359 | CAGGAACUGAAU | 2908 | AD-20562, AD-20559, AD-20563, AD-20558, AD-20560, AD-20564, AD-20565, AD-20561 |
| 738 | UUCAGUUCCUGA | 2360 | UCAGGAACUGAA | 2909 | AD-20566, AD-20562, AD-20559, AD-20563, AD-20560, AD-20564, AD-20565, AD-20561 |
| 739 | UCAGUUCCUGAU | 2361 | AUCAGGAACUGA | 2910 | AD-20566, AD-20562, AD-20563, AD-20560, AD-20564, AD-20565, AD-20561 |
| 740 | CAGUUCCUGAUC | 2362 | GAUCAGGAACUG | 2911 | AD-20566, AD-20562, AD-20563, AD-20564, AD-20565, AD-20561 |
| 741 | AGUUCCUGAUCU | 2363 | AGAUCAGGAACU | 2912 | AD-20569, AD-20566, AD-20562, AD-20563, AD-20564, AD-20565 |
| 742 | GUUCCUGAUCUC | 2364 | GAGAUCAGGAAC | 2913 | AD-20569, AD-20566, AD-20563, AD-20570, AD-20564, AD-20565 |
| 743 | UUCCUGAUCUCA | 2365 | UGAGAUCAGGAA | 2914 | AD-20569, AD-20566, AD-20570, AD-20564, AD-20565 |
| 744 | UCCUGAUCUCAC | 2366 | GUGAGAUCAGGA | 2915 | AD-20569, AD-20566, AD-20572, AD-20570, AD-20565 |
| 745 | CCUGAUCUCACU | 2367 | AGUGAGAUCAGG | 2916 | AD-20569, AD-20566, AD-20572, AD-20570 |
| 746 | CUGAUCUCACUG | 2368 | CAGUGAGAUCAG | 2917 | AD-20569, AD-20572, AD-20570, AD-20574 |
| 747 | UGAUCUCACUGG | 2369 | CCAGUGAGAUCA | 2918 | AD-20569, AD-20572, AD-20570, AD-20574, AD-20575 |
| 748 | GAUCUCACUGGU | 2370 | ACCAGUGAGAUC | 2919 | AD-20569, AD-20576, AD-20572, AD-20570, AD-20574, AD-20575 |
| 749 | AUCUCACUGGUG | 2371 | CACCAGUGAGAU | 2920 | AD-20576, AD-20577, AD-20572, AD-20570, AD-20574, AD-20575 |
| 750 | UCUCACUGGUGC | 2372 | GCACCAGUGAGA | 2921 | AD-20578, AD-20576, AD-20577, AD-20572, AD-20574, AD-20575 |

TABLE 3A-continued

| OVERLAPPING siRNAs | | | | |
|---|---|---|---|---|
| Position | Sense overlap | SEQ ID NO: | Antisense overlap | SEQ ID NO: | RNAi Agents that overlap by at least 12 nt with each other |

| Position | Sense overlap | SEQ ID NO: | Antisense overlap | SEQ ID NO: | RNAi Agents that overlap by at least 12 nt with each other |
|---|---|---|---|---|---|
| 751 | CUCACUGGUGCA | 2373 | UGCACCAGUGAG | 2922 | AD-20578, AD-20577, AD-20579, AD-20577, AD-20572, AD-20574, AD-20575 |
| 752 | UCACUGGUGCAG | 2374 | CUGCACCAGUGA | 2923 | AD-20580, AD-20578, AD-20576, AD-20579, AD-20577, AD-20574, AD-20575 |
| 753 | CACUGGUGCAGU | 2375 | ACUGCACCAGUG | 2924 | AD-20580, AD-20578, AD-20576, AD-20579, AD-20577, AD-20574, AD-20575 |
| 754 | ACUGGUGCAGUC | 2376 | GACUGCACCAGU | 2925 | AD-20580, AD-20578, AD-20576, AD-20579, AD-20577, AD-20582, AD-20575 |
| 755 | CUGGUGCAGUCA | 2377 | UGACUGCACCAG | 2926 | AD-20580, AD-20578, AD-20576, AD-20579, AD-20577, AD-20582, AD-20625 |
| 756 | UGGUGCAGUCAA | 2378 | UUGACUGCACCA | 2927 | AD-20580, AD-20626, AD-20578, AD-20579, AD-20577, AD-20582, AD-20625 |
| 757 | GGUGCAGUCAAA | 2379 | UUUGACUGCACC | 2928 | AD-20580, AD-20627, AD-20626, AD-20578, AD-20579, AD-20582, AD-20625 |
| 758 | GUGCAGUCAAAC | 2380 | GUUUGACUGCAC | 2929 | AD-20580, AD-20627, AD-20626, AD-20579, AD-20582, AD-20625 |
| 759 | UGCAGUCAAACC | 2381 | GGUUUGACUGCA | 2930 | AD-20580, AD-20627, AD-20626, AD-20582, AD-20629, AD-20625 |
| 760 | GCAGUCAAACCG | 2382 | CGGUUUGACUGC | 2931 | AD-20627, AD-20626, AD-20582, AD-20629, AD-20625 |
| 761 | CAGUCAAACCGG | 2383 | CCGGUUUGACUG | 2932 | AD-20627, AD-20626, AD-20582, AD-20629, AD-20625 |
| 762 | AGUCAAACCGGA | 2384 | UCCGGUUUGACU | 2933 | AD-20627, AD-20626, AD-20629, AD-20625 |
| 763 | GUCAAACCGGAU | 2385 | AUCCGGUUUGAC | 2934 | AD-20627, AD-20626, AD-20629 |
| 764 | UCAAACCGGAUC | 2386 | GAUCCGGUUUGA | 2935 | AD-20627, AD-20629 |
| 765 | CAAACCGGAUCC | 2387 | GGAUCCGGUUUG | 2936 | AD-20628, AD-20629 |
| 766 | AAACCGGAUCCU | 2388 | AGGAUCCGGUUU | 2937 | AD-20630, AD-20629 |
| 767 | AACCGGAUCCUG | 2389 | CAGGAUCCGGUU | 2938 | AD-20630, AD-20632 |
| 768 | ACCGGAUCCUGG | 2390 | CCAGGAUCCGGU | 2939 | AD-20632, AD-20631 |
| 799 | CCUGAUGCUGAA | 2391 | UUCAGCAUCAGG | 2940 | AD-20634, AD-20635 |
| 800 | CUGAUGCUGAAC | 2392 | GUUCAGCAUCAG | 2941 | AD-20634, AD-20636 |
| 801 | UGAUGCUGAACG | 2393 | CGUUCAGCAUCA | 2942 | AD-20637, AD-20634 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 802 | GAUGCUGAACGA | 2394 | UCGUUCAGCAUC | 2943 | AD-20634, AD-20638 |
| 803 | AUGCUGAACGAC | 2395 | GUCGUUCAGCAU | 2944 | AD-20639, AD-20634, AD-20638 |
| 804 | UGCUGAACGACA | 2396 | UGUCGUUCAGCA | 2945 | AD-20640, AD-20639, AD-20634, AD-20638 |
| 805 | GCUGAACGACAG | 2397 | CUGUCGUUCAGC | 2946 | AD-20641, AD-20640, AD-20639, AD-20634, AD-20638 |
| 806 | CUGAACGACAGU | 2398 | ACUGUCGUUCAG | 2947 | AD-20641, AD-20640, AD-20639, AD-20638 |
| 807 | UGAACGACAGUG | 2399 | CACUGUCGUUCA | 2948 | AD-20641, AD-20643, AD-20640, AD-20639, AD-20638 |
| 808 | GAACGACAGUGG | 2400 | CCACUGUCGUUC | 2949 | AD-20641, AD-20643, AD-20640, AD-20639, AD-20638, AD-20644 |
| 809 | AACGACAGUGGC | 2401 | GCCACUGUCGUU | 2950 | AD-20641, AD-20643, AD-20640, AD-20639, AD-20638, AD-20644 |
| 810 | ACGACAGUGGCU | 2402 | AGCCACUGUCGU | 2951 | AD-20646, AD-20643, AD-20640, AD-20639, AD-20644 |
| 811 | CGACAGUGGCUC | 2403 | GAGCCACUGUCG | 2952 | AD-20646, AD-20643, AD-20640, AD-20644 |
| 812 | GACAGUGGCUCA | 2404 | UGAGCCACUGUC | 2953 | AD-20646, AD-20643, AD-20648, AD-20644 |
| 813 | ACAGUGGCUCAG | 2405 | CUGAGCCACUGU | 2954 | AD-20646, AD-20643, AD-20648, AD-20644 |
| 814 | CAGUGGCUCAGC | 2406 | GCUGAGCCACUG | 2955 | AD-20646, AD-20643, AD-20650, AD-20648, AD-20644 |
| 815 | AGUGGCUCAGCA | 2407 | UGCUGAGCCACU | 2956 | AD-20651, AD-20646, AD-20650, AD-20648, AD-20644 |
| 816 | GUGGCUCAGCAC | 2408 | GUGCUGAGCCAC | 2957 | AD-20651, AD-20646, AD-20650, AD-20652, AD-20648 |
| 817 | UGGCUCAGCACA | 2409 | UGUGCUGAGCCA | 2958 | AD-20651, AD-20646, AD-20653, AD-20650, AD-20652, AD-20648 |
| 818 | GGCUCAGCACAU | 2410 | AUGUGCUGAGCC | 2959 | AD-20653, AD-20650, AD-20652, AD-20648 |
| 819 | GCUCAGCACAUU | 2411 | AAUGUGCUGAGC | 2960 | AD-20653, AD-20650, AD-20652, AD-20648 |
| 820 | CUCAGCACAUUC | 2412 | GAAUGUGCUGAG | 2961 | AD-20653, AD-20650, AD-20652 |
| 821 | UCAGCACAUUCC | 2413 | GGAAUGUGCUGA | 2962 | AD-20653, AD-20650, AD-20652 |
| 822 | CAGCACAUUCCA | 2414 | UGGAAUGUGCUG | 2963 | AD-20653, AD-20652, AD-20658 |
| 823 | AGCACAUUCCAU | 2415 | AUGGAAUGUGCU | 2964 | AD-20659, AD-20653, AD-20652, AD-20658 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 824 | GCACAUUCCAUG | 2416 | CAUGGAAUGUGC | 2965 | AD-20659, AD-20660, AD-20653, AD-20658 |
| 825 | CACAUUCCAUGC | 2417 | GCAUGGAAUGUG | 2966 | AD-20659, AD-20660, AD-20661, AD-20658 |
| 826 | ACAUUCCAUGCC | 2418 | GGCAUGGAAUGU | 2967 | AD-20659, AD-20660, AD-20284, AD-20661, AD-20658 |
| 827 | CAUUCCAUGCCC | 2419 | GGGCAUGGAAUG | 2968 | AD-20659, AD-20660, AD-20284, AD-20661, AD-20658 |
| 828 | AUUCCAUGCCCA | 2420 | UGGGCAUGGAAU | 2969 | AD-20659, AD-20660, AD-20284, AD-20661, AD-20658 |
| 829 | UUCCAUGCCCAA | 2421 | UUGGGCAUGGAA | 2970 | AD-20659, AD-20660, AD-20284, AD-20661, AD-20658 |
| 830 | UCCAUGCCCAAG | 2422 | CUUGGGCAUGGA | 2971 | AD-20659, AD-20660, AD-20284, AD-20661 |
| 831 | CCAUGCCCAAGU | 2423 | ACUUGGGCAUGG | 2972 | AD-20660, AD-20284, AD-20661 |
| 832 | CAUGCCCAAGUA | 2424 | UACUUGGGCAUG | 2973 | AD-20284, AD-20661 |
| 847 | CCGGCAGUUCUC | 2425 | GAGAACUGCCGG | 2974 | AD-20662, AD-20868 |
| 848 | CGGCAGUUCUCC | 2426 | GGAGAACUGCCG | 2975 | AD-20663, AD-20868 |
| 849 | GGCAGUUCUCCC | 2427 | GGGAGAACUGCC | 2976 | AD-20664, AD-20868 |
| 850 | GCAGUUCUCCCU | 2428 | AGGGAGAACUGC | 2977 | AD-20665, AD-20868 |
| 851 | CAGUUCUCCCUG | 2429 | CAGGGAGAACUG | 2978 | AD-20666, AD-20868 |
| 852 | AGUUCUCCCUGG | 2430 | CCAGGGAGAACU | 2979 | AD-20666, AD-20868 |
| 853 | GUUCUCCCUGGA | 2431 | UCCAGGGAGAAC | 2980 | AD-20666, AD-20868 |
| 854 | UUCUCCCUGGAG | 2432 | CUCCAGGGAGAA | 2981 | AD-20666, AD-20868 |
| 855 | UCUCCCUGGAGC | 2433 | GCUCCAGGGAGA | 2982 | AD-20666, AD-20664 |
| 856 | CUCCCUGGAGCA | 2434 | UGCUCCAGGGAG | 2983 | AD-20666, AD-20671 |
| 857 | UCCCUGGAGCAC | 2435 | GUGCUCCAGGGA | 2984 | AD-20672, AD-20671 |
| 858 | CCCUGGAGCACG | 2436 | CGUGCUCCAGGG | 2985 | AD-20672, AD-20671 |
| 859 | CCUGGAGCACGU | 2437 | ACGUGCUCCAGG | 2986 | AD-20672, AD-20671 |
| 860 | CUGGAGCACGUC | 2438 | GACGUGCUCCAG | 2987 | AD-20672, AD-20671 |
| 861 | UGGAGCACGUCC | 2439 | GGACGUGCUCCA | 2988 | AD-20672, AD-20671, AD-20676 |
| 862 | GGAGCACGUCCA | 2440 | UGGACGUGCUCC | 2989 | AD-20672, AD-20671, AD-20676 |
| 863 | GAGCACGUCCAC | 2441 | GUGGACGUGCUC | 2990 | AD-20672, AD-20671, AD-20676 |
| 864 | AGCACGUCCACG | 2442 | CGUGGACGUGCU | 2991 | AD-20672, AD-20676 |
| 865 | GCACGUCCACGG | 2443 | CCGUGGACGUGC | 2992 | AD-20675, AD-20676 |
| 866 | CACGUCCACGGC | 2444 | GCCGUGGACGUG | 2993 | AD-20675, AD-20676 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 867 | ACGUCCACGGCU | 2445 | AGCCGUGGACGU | 2994 | AD-20675, AD-20676 |
| 965 | UCCGACAUCACC | 2446 | GGUGAUGUCGGA | 2995 | AD-20679, AD-20678 |
| 966 | CCGACAUCACCG | 2447 | CGGUGAUGUCGG | 2996 | AD-20680, AD-20678 |
| 967 | CGACAUCACCGA | 2448 | UCGGUGAUGUCG | 2997 | AD-20681, AD-20678 |
| 968 | GACAUCACCGAG | 2449 | CUCGGUGAUGUC | 2998 | AD-20678, AD-20682 |
| 969 | ACAUCACCGAGC | 2450 | GCUCGGUGAUGU | 2999 | AD-20678, AD-20682 |
| 970 | CAUCACCGAGCU | 2451 | AGCUCGGUGAUG | 3000 | AD-20678, AD-20682 |
| 971 | AUCACCGAGCUG | 2452 | CAGCUCGGUGAU | 3001 | AD-20678, AD-20682 |
| 972 | UCACCGAGCUGG | 2453 | CCAGCUCGGUGA | 3002 | AD-20686, AD-20682 |
| 973 | CACCGAGCUGGC | 2454 | GCCAGCUCGGUG | 3003 | AD-20686, AD-20687 |
| 974 | ACCGAGCUGGCU | 2455 | AGCCAGCUCGGU | 3004 | AD-20686, AD-20687 |
| 975 | CCGAGCUGGCUC | 2456 | GAGCCAGCUCGG | 3005 | AD-20686, AD-20689 |
| 976 | CGAGCUGGCUCC | 2457 | GGAGCCAGCUCG | 3006 | AD-20686, AD-20689 |
| 977 | GAGCUGGCUCCU | 2458 | AGGAGCCAGCUC | 3007 | AD-20686, AD-20689 |
| 978 | AGCUGGCUCCUG | 2459 | CAGGAGCCAGCU | 3008 | AD-20686, AD-20689 |
| 979 | GCUGGCUCCUGC | 2460 | GCAGGAGCCAGC | 3009 | AD-20686, AD-20689 |
| 980 | CUGGCUCCUGCC | 2461 | GGCAGGAGCCAG | 3010 | AD-20691, AD-20689 |
| 981 | UGGCUCCUGCCA | 2462 | UGGCAGGAGCCA | 3011 | AD-20691, AD-20689 |
| 982 | GGCUCCUGCCAG | 2463 | CUGGCAGGAGCC | 3012 | AD-20691, AD-20689 |
| 983 | GCUCCUGCCAGC | 2464 | GCUGGCAGGAGC | 3013 | AD-20692, AD-20691 |
| 984 | CUCCUGCCAGCC | 2465 | GGCUGGCAGGAG | 3014 | AD-20692, AD-20691 |
| 1011 | GCGGGAGCAUAG | 2466 | CUAUGCUCCCGC | 3015 | AD-20693, AD-20694 |
| 1012 | CGGGAGCAUAGA | 2467 | UCUAUGCUCCCG | 3016 | AD-20693, AD-20694 |
| 1013 | GGGAGCAUAGAC | 2468 | GUCUAUGCUCCC | 3017 | AD-20693, AD-20694 |
| 1014 | GGAGCAUAGACG | 2469 | CGUCUAUGCUCC | 3018 | AD-20693, AD-20694 |
| 1015 | GAGCAUAGACGA | 2470 | UCGUCUAUGCUC | 3019 | AD-20693, AD-20694 |
| 1016 | AGCAUAGACGAG | 2471 | CUCGUCUAUGCU | 3020 | AD-20693, AD-20694 |
| 1017 | GCAUAGACGAGA | 2472 | UCUCGUCUAUGC | 3021 | AD-20693, AD-20694 |
| 1018 | CAUAGACGAGAG | 2473 | CUCUCGUCUAUG | 3022 | AD-20698, AD-20694 |
| 1019 | AUAGACGAGAGG | 2474 | CCUCUCGUCUAU | 3023 | AD-20697, AD-20698 |
| 1020 | UAGACGAGAGGC | 2475 | GCCUCUCGUCUA | 3024 | AD-20697, AD-20698 |
| 1021 | AGACGAGAGGCC | 2476 | GGCCUCUCGUCU | 3025 | AD-20697, AD-20698 |
| 1048 | CCUGGUGCGUGU | 2477 | ACACGCACCAGG | 3026 | AD-20700, AD-20699 |
| 1049 | CUGGUGCGUGUC | 2478 | GACACGCACCAG | 3027 | AD-20700, AD-20699 |
| 1050 | UGGUGCGUGUCA | 2479 | UGACACGCACCA | 3028 | AD-20700, AD-20702 |
| 1051 | GGUGCGUGUCAA | 2480 | UUGACACGCACC | 3029 | AD-20700, AD-20702 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 1052 | GUGCGUGUCAAG | 2481 | CUUGACACGCAC | 3030 | AD-20700, AD-20703, AD-20702 |
| 1053 | UGCGUGUCAAGG | 2482 | CCUUGACACGCA | 3031 | AD-20700, AD-20703, AD-20702 |
| 1054 | GCGUGUCAAGGA | 2483 | UCCUUGACACGC | 3032 | AD-20700, AD-20703, AD-20702 |
| 1055 | CGUGUCAAGGAG | 2484 | CUCCUUGACACG | 3033 | AD-20700, AD-20703, AD-20702 |
| 1056 | GUGUCAAGGAGG | 2485 | CCUCCUUGACAC | 3034 | AD-20703, AD-20702 |
| 1057 | UGUCAAGGAGGA | 2486 | UCCUCCUUGACA | 3035 | AD-20703, AD-20702 |
| 1058 | GUCAAGGAGGAG | 2487 | CUCCUCCUUGAC | 3036 | AD-20705, AD-20703 |
| 1059 | UCAAGGAGGAGC | 2488 | GCUCCUCCUUGA | 3037 | AD-20705, AD-20703 |
| 1060 | CAAGGAGGAGCC | 2489 | GGCUCCUCCUUG | 3038 | AD-20705, AD-20704 |
| 1329 | ACUUGGAUGCUA | 2490 | UAGCAUCCAAGU | 3039 | AD-20707, AD-20706 |
| 1330 | CUUGGAUGCUAU | 2491 | AUAGCAUCCAAG | 3040 | AD-20707, AD-20708 |
| 1331 | UUGGAUGCUAUG | 2492 | CAUAGCAUCCAA | 3041 | AD-20707, AD-20709 |
| 1332 | UGGAUGCUAUGG | 2493 | CCAUAGCAUCCA | 3042 | AD-20707, AD-20710, AD-20709 |
| 1333 | GGAUGCUAUGGA | 2494 | UCCAUAGCAUCC | 3043 | AD-20707, AD-20710, AD-20709 |
| 1334 | GAUGCUAUGGAC | 2495 | GUCCAUAGCAUC | 3044 | AD-20707, AD-20710, AD-20709 |
| 1335 | AUGCUAUGGACU | 2496 | AGUCCAUAGCAU | 3045 | AD-20713, AD-20707, AD-20710, AD-20709 |
| 1336 | UGCUAUGGACUC | 2497 | GAGUCCAUAGCA | 3046 | AD-20713, AD-20714, AD-20707, AD-20710, AD-20709 |
| 1337 | GCUAUGGACUCC | 2498 | GGAGUCCAUAGC | 3047 | AD-20713, AD-20714, AD-20710, AD-20709 |
| 1338 | CUAUGGACUCCA | 2499 | UGGAGUCCAUAG | 3048 | AD-20713, AD-20714, AD-20710, AD-20709, AD-20716 |
| 1339 | UAUGGACUCCAA | 2500 | UUGGAGUCCAUA | 3049 | AD-20713, AD-20714, AD-20710 |
| 1340 | AUGGACUCCAAC | 2501 | GUUGGAGUCCAU | 3050 | AD-20713, AD-20714 |
| 1341 | UGGACUCCAACC | 2502 | GGUUGGAGUCCA | 3051 | AD-20713, AD-20714 |
| 1342 | GGACUCCAACCU | 2503 | AGGUUGGAGUCC | 3052 | AD-20713, AD-20714 |
| 1343 | GACUCCAACCUG | 2504 | CAGGUUGGAGUC | 3053 | AD-20714, AD-20716 |
| 1344 | ACUCCAACCUGG | 2505 | CCAGGUUGGAGU | 3054 | AD-20716, AD-20715 |
| 1359 | ACCUGCAGACCA | 2506 | UGGUCUGCAGGU | 3055 | AD-20717, AD-20718 |
| 1360 | CCUGCAGACCAU | 2507 | AUGGUCUGCAGG | 3056 | AD-20717, AD-20718 |
| 1361 | CUGCAGACCAUG | 2508 | CAUGGUCUGCAG | 3057 | AD-20720, AD-20718 |
| 1362 | UGCAGACCAUGC | 2509 | GCAUGGUCUGCA | 3058 | AD-20718, AD-20721 |
| 1363 | GCAGACCAUGCU | 2510 | AGCAUGGUCUGC | 3059 | AD-20718, AD-20722 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 1364 | CAGACCAUGCUG | 2511 | CAGCAUGGUCUG | 3060 | AD-20718, AD-20722 |
| 1365 | AGACCAUGCUGA | 2512 | UCAGCAUGGUCU | 3061 | AD-20718, AD-20722 |
| 1366 | GACCAUGCUGAG | 2513 | CUCAGCAUGGUC | 3062 | AD-20718, AD-20722 |
| 1367 | ACCAUGCUGAGC | 2514 | GCUCAGCAUGGU | 3063 | AD-20726, AD-20722 |
| 1368 | CCAUGCUGAGCA | 2515 | UGCUCAGCAUGG | 3064 | AD-20727, AD-20722 |
| 1369 | CAUGCUGAGCAG | 2516 | CUGCUCAGCAUG | 3065 | AD-20728, AD-20722 |
| 1370 | AUGCUGAGCAGC | 2517 | GCUGCUCAGCAU | 3066 | AD-20728, AD-20722 |
| 1371 | UGCUGAGCAGCC | 2518 | GGCUGCUCAGCA | 3067 | AD-20728, AD-20730 |
| 1372 | GCUGAGCAGCCA | 2519 | UGGCUGCUCAGC | 3068 | AD-20728, AD-20730 |
| 1373 | CUGAGCAGCCAC | 2520 | GUGGCUGCUCAG | 3069 | AD-20728, AD-20730 |
| 1374 | UGAGCAGCCACG | 2521 | CGUGGCUGCUCA | 3070 | AD-20728, AD-20730 |
| 1375 | GAGCAGCCACGG | 2522 | CCGUGGCUGCUC | 3071 | AD-20728, AD-20730 |
| 1376 | AGCAGCCACGGC | 2523 | GCCGUGGCUGCU | 3072 | AD-20728, AD-20730 |
| 1377 | GCAGCCACGGCU | 2524 | AGCCGUGGCUGC | 3073 | AD-20733, AD-20730 |
| 1378 | CAGCCACGGCUU | 2525 | AAGCCGUGGCUG | 3074 | AD-20733, AD-20730 |
| 1379 | AGCCACGGCUUC | 2526 | GAAGCCGUGGCU | 3075 | AD-20733, AD-20735 |
| 1380 | GCCACGGCUUCA | 2527 | UGAAGCCGUGGC | 3076 | AD-20733, AD-20736 |
| 1381 | CCACGGCUUCAG | 2528 | CUGAAGCCGUGG | 3077 | AD-20733, AD-20736 |
| 1382 | CACGGCUUCAGC | 2529 | GCUGAAGCCGUG | 3078 | AD-20738, AD-20736 |
| 1383 | ACGGCUUCAGCG | 2530 | CGCUGAAGCCGU | 3079 | AD-20739, AD-20736 |
| 1384 | CGGCUUCAGCGU | 2531 | ACGCUGAAGCCG | 3080 | AD-20739, AD-20740 |
| 1385 | GGCUUCAGCGUG | 2532 | CACGCUGAAGCC | 3081 | AD-20741, AD-20740 |
| 1386 | GCUUCAGCGUGG | 2533 | CCACGCUGAAGC | 3082 | AD-20742, AD-20741 |
| 1387 | CUUCAGCGUGGA | 2534 | UCCACGCUGAAG | 3083 | AD-20742, AD-20741 |
| 1388 | UUCAGCGUGGAC | 2535 | GUCCACGCUGAA | 3084 | AD-20742, AD-20741 |
| 1389 | UCAGCGUGGACA | 2536 | UGUCCACGCUGA | 3085 | AD-20742, AD-20741 |
| 1390 | CAGCGUGGACAC | 2537 | GUGUCCACGCUG | 3086 | AD-20742, AD-20741 |
| 1391 | AGCGUGGACACC | 2538 | GGUGUCCACGCU | 3087 | AD-20742, AD-20741 |
| 1392 | GCGUGGACACCA | 2539 | UGGUGUCCACGC | 3088 | AD-20742, AD-20741 |
| 1407 | CCCUGCUGGACC | 2540 | GGUCCAGCAGGG | 3089 | AD-20744, AD-20743 |
| 1408 | CCUGCUGGACCU | 2541 | AGGUCCAGCAGG | 3090 | AD-20744, AD-20743 |
| 1409 | CUGCUGGACCUG | 2542 | CAGGUCCAGCAG | 3091 | AD-20746, AD-20743 |
| 1410 | UGCUGGACCUGU | 2543 | ACAGGUCCAGCA | 3092 | AD-20746, AD-20743 |
| 1411 | GCUGGACCUGUU | 2544 | AACAGGUCCAGC | 3093 | AD-20746, AD-20743 |
| 1412 | CUGGACCUGUUC | 2545 | GAACAGGUCCAG | 3094 | AD-20746, AD-20743 |
| 1413 | UGGACCUGUUCA | 2546 | UGAACAGGUCCA | 3095 | AD-20746, AD-20743 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 1414 | GGACCUGUUCAG | 2547 | CUGAACAGGUCC | 3096 | AD-20746, AD-20747 |
| 1415 | GACCUGUUCAGC | 2548 | GCUGAACAGGUC | 3097 | AD-20746, AD-20747 |
| 1416 | ACCUGUUCAGCC | 2549 | GGCUGAACAGGU | 3098 | AD-20746, AD-20747 |
| 1428 | CCUCGGUGACCG | 2550 | CGGUCACCGAGG | 3099 | AD-20749, AD-20748 |
| 1429 | CUCGGUGACCGU | 2551 | ACGGUCACCGAG | 3100 | AD-20749, AD-20750 |
| 1430 | UCGGUGACCGUG | 2552 | CACGGUCACCGA | 3101 | AD-20751, AD-20750 |
| 1431 | CGGUGACCGUGC | 2553 | GCACGGUCACCG | 3102 | AD-20751, AD-20752 |
| 1432 | GGUGACCGUGCC | 2554 | GGCACGGUCACC | 3103 | AD-20751, AD-20753 |
| 1433 | GUGACCGUGCCC | 2555 | GGGCACGGUCAC | 3104 | AD-20751, AD-20754 |
| 1434 | UGACCGUGCCCG | 2556 | CGGGCACGGUCA | 3105 | AD-20751, AD-20755 |
| 1435 | GACCGUGCCCGA | 2557 | UCGGGCACGGUC | 3106 | AD-20751, AD-20756 |
| 1436 | ACCGUGCCCGAC | 2558 | GUCGGGCACGGU | 3107 | AD-20751, AD-20757 |
| 1437 | CCGUGCCCGACA | 2559 | UGUCGGGCACGG | 3108 | AD-20751, AD-20758 |
| 1438 | CGUGCCCGACAU | 2560 | AUGUCGGGCACG | 3109 | AD-20759, AD-20758 |
| 1439 | GUGCCCGACAUG | 2561 | CAUGUCGGGCAC | 3110 | AD-20760, AD-20759 |
| 1440 | UGCCCGACAUGA | 2562 | UCAUGUCGGGCA | 3111 | AD-20760, AD-20761 |
| 1441 | GCCCGACAUGAG | 2563 | CUCAUGUCGGGC | 3112 | AD-20760, AD-20762 |
| 1442 | CCCGACAUGAGC | 2564 | GCUCAUGUCGGG | 3113 | AD-20763, AD-20762 |
| 1443 | CCGACAUGAGCC | 2565 | GGCUCAUGUCGG | 3114 | AD-20763, AD-20764 |
| 1444 | CGACAUGAGCCU | 2566 | AGGCUCAUGUCG | 3115 | AD-20763, AD-20764 |
| 1445 | GACAUGAGCCUG | 2567 | CAGGCUCAUGUC | 3116 | AD-20763, AD-20764 |
| 1446 | ACAUGAGCCUGC | 2568 | GCAGGCUCAUGU | 3117 | AD-20763, AD-20764 |
| 1447 | CAUGAGCCUGCC | 2569 | GGCAGGCUCAUG | 3118 | AD-20768, AD-20764 |
| 1448 | AUGAGCCUGCCU | 2570 | AGGCAGGCUCAU | 3119 | AD-20768, AD-20764 |
| 1449 | UGAGCCUGCCUG | 2571 | CAGGCAGGCUCA | 3120 | AD-20768, AD-20764 |
| 1450 | GAGCCUGCCUGA | 2572 | UCAGGCAGGCUC | 3121 | AD-20771, AD-20764 |
| 1451 | AGCCUGCCUGAC | 2573 | GUCAGGCAGGCU | 3122 | AD-20771, AD-20772 |
| 1452 | GCCUGCCUGACC | 2574 | GGUCAGGCAGGC | 3123 | AD-20771, AD-20773 |
| 1453 | CCUGCCUGACCU | 2575 | AGGUCAGGCAGG | 3124 | AD-20771, AD-20774 |
| 1454 | CUGCCUGACCUU | 2576 | AAGGUCAGGCAG | 3125 | AD-20771, AD-20775 |
| 1455 | UGCCUGACCUUG | 2577 | CAAGGUCAGGCA | 3126 | AD-20771, AD-20776 |
| 1456 | GCCUGACCUUGA | 2578 | UCAAGGUCAGGC | 3127 | AD-20771, AD-20777 |
| 1457 | CCUGACCUUGAC | 2579 | GUCAAGGUCAGG | 3128 | AD-20771, AD-20778 |
| 1458 | CUGACCUUGACA | 2580 | UGUCAAGGUCAG | 3129 | AD-20779, AD-20778 |
| 1459 | UGACCUUGACAG | 2581 | CUGUCAAGGUCA | 3130 | AD-20779, AD-20780 |
| 1460 | GACCUUGACAGC | 2582 | GCUGUCAAGGUC | 3131 | AD-20779, AD-20780 |
| 1461 | ACCUUGACAGCA | 2583 | UGCUGUCAAGGU | 3132 | AD-20779, AD-20780 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 1462 | CCUUGACAGCAG | 2584 | CUGCUGUCAAGG | 3133 | AD-20779, AD-20780 |
| 1463 | CUUGACAGCAGC | 2585 | GCUGCUGUCAAG | 3134 | AD-20779, AD-20780 |
| 1464 | UUGACAGCAGCC | 2586 | GGCUGCUGUCAA | 3135 | AD-20779, AD-20780 |
| 1465 | UGACAGCAGCCU | 2587 | AGGCUGCUGUCA | 3136 | AD-20779, AD-20780 |
| 1466 | GACAGCAGCCUG | 2588 | CAGGCUGCUGUC | 3137 | AD-20781, AD-20780 |
| 1467 | ACAGCAGCCUGG | 2589 | CCAGGCUGCUGU | 3138 | AD-20781, AD-20782 |
| 1482 | GUAUCCAAGAGC | 2590 | GCUCUUGGAUAC | 3139 | AD-20783, AD-20784 |
| 1483 | UAUCCAAGAGCU | 2591 | AGCUCUUGGAUA | 3140 | AD-20783, AD-20785, AD-20784 |
| 1484 | AUCCAAGAGCUC | 2592 | GAGCUCUUGGAU | 3141 | AD-20783, AD-20785, AD-20784 |
| 1485 | UCCAAGAGCUCC | 2593 | GGAGCUCUUGGA | 3142 | AD-20783, AD-20785, AD-20784 |
| 1486 | CCAAGAGCUCCU | 2594 | AGGAGCUCUUGG | 3143 | AD-20783, AD-20785, AD-20784 |
| 1487 | CAAGAGCUCCUG | 2595 | CAGGAGCUCUUG | 3144 | AD-20783, AD-20785, AD-20784 |
| 1488 | AAGAGCUCCUGU | 2596 | ACAGGAGCUCUU | 3145 | AD-20783, AD-20785, AD-20784 |
| 1489 | AGAGCUCCUGUC | 2597 | GACAGGAGCUCU | 3146 | AD-20785, AD-20784 |
| 1490 | GAGCUCCUGUCU | 2598 | AGACAGGAGCUC | 3147 | AD-20786, AD-20785 |
| 1491 | AGCUCCUGUCUC | 2599 | GAGACAGGAGCU | 3148 | AD-20786, AD-20788 |
| 1492 | GCUCCUGUCUCC | 2600 | GGAGACAGGAGC | 3149 | AD-20788, AD-20787 |
| 1547 | GAUUCAGGGAAG | 2601 | CUUCCCUGAAUC | 3150 | AD-20789, AD-20790 |
| 1548 | AUUCAGGGAAGC | 2602 | GCUUCCCUGAAU | 3151 | AD-20789, AD-20791 |
| 1549 | UUCAGGGAAGCA | 2603 | UGCUUCCCUGAA | 3152 | AD-20789, AD-20791 |
| 1550 | UCAGGGAAGCAG | 2604 | CUGCUUCCCUGA | 3153 | AD-20789, AD-20791 |
| 1551 | CAGGGAAGCAGC | 2605 | GCUGCUUCCCUG | 3154 | AD-20789, AD-20791 |
| 1552 | AGGGAAGCAGCU | 2606 | AGCUGCUUCCCU | 3155 | AD-20789, AD-20791 |
| 1553 | GGGAAGCAGCUG | 2607 | CAGCUGCUUCCC | 3156 | AD-20789, AD-20791 |
| 1554 | GGAAGCAGCUGG | 2608 | CCAGCUGCUUCC | 3157 | AD-20790, AD-20791 |
| 1602 | CCGGCUCCGUGG | 2609 | CCACGGAGCCGG | 3158 | AD-20793, AD-20792 |
| 1603 | CGGCUCCGUGGA | 2610 | UCCACGGAGCCG | 3159 | AD-20793, AD-20792 |
| 1604 | GGCUCCGUGGAC | 2611 | GUCCACGGAGCC | 3160 | AD-20795, AD-20792 |
| 1605 | GCUCCGUGGACA | 2612 | UGUCCACGGAGC | 3161 | AD-20795, AD-20792 |
| 1606 | CUCCGUGGACAC | 2613 | GUGUCCACGGAG | 3162 | AD-20795, AD-20870 |
| 1607 | UCCGUGGACACC | 2614 | GGUGUCCACGGA | 3163 | AD-20871, AD-20870 |
| 1608 | CCGUGGACACCG | 2615 | CGGUGUCCACGG | 3164 | AD-20871, AD-20870 |
| 1609 | CGUGGACACCGG | 2616 | CCGGUGUCCACG | 3165 | AD-20871, AD-20870 |

TABLE 3A-continued

OVERLAPPING siRNAs

| Position | Sense overlap | SEQ ID NO: | Antisense overlap | SEQ ID NO: | RNAi Agents that overlap by at least 12 nt with each other |
|---|---|---|---|---|---|
| 1610 | GUGGACACCGGG | 2617 | CCCGGUGUCCAC | 3166 | AD-20871, AD-20870 |
| 1611 | UGGACACCGGGA | 2618 | UCCCGGUGUCCA | 3167 | AD-20871, AD-20870 |
| 1612 | GGACACCGGGAG | 2619 | CUCCCGGUGUCC | 3168 | AD-20871, AD-20870 |
| 1613 | GACACCGGGAGC | 2620 | GCUCCCGGUGUC | 3169 | AD-20871, AD-20870 |
| 1633 | GCCGGUGCUGUU | 2621 | AACAGCACCGGC | 3170 | AD-20797, AD-20872 |
| 1634 | CCGGUGCUGUUU | 2622 | AAACAGCACCGG | 3171 | AD-20872, AD-20798 |
| 1635 | CGGUGCUGUUUG | 2623 | CAAACAGCACCG | 3172 | AD-20872, AD-20799 |
| 1636 | GGUGCUGUUUGA | 2624 | UCAAACAGCACC | 3173 | AD-20872, AD-20799 |
| 1637 | GUGCUGUUUGAG | 2625 | CUCAAACAGCAC | 3174 | AD-20872, AD-20799 |
| 1638 | UGCUGUUUGAGC | 2626 | GCUCAAACAGCA | 3175 | AD-20872, AD-20799 |
| 1639 | GCUGUUUGAGCU | 2627 | AGCUCAAACAGC | 3176 | AD-20872, AD-20799 |
| 1640 | CUGUUUGAGCUG | 2628 | CAGCUCAAACAG | 3177 | AD-20798, AD-20799 |
| 1641 | UGUUUGAGCUGG | 2629 | CCAGCUCAAACA | 3178 | AD-20798, AD-20799 |
| 1698 | CCACCAUCUCCC | 2630 | GGGAGAUGGUGG | 3179 | AD-20873, AD-20800 |
| 1699 | CACCAUCUCCCU | 2631 | AGGGAGAUGGUG | 3180 | AD-20801, AD-20800 |
| 1700 | ACCAUCUCCCUG | 2632 | CAGGGAGAUGGU | 3181 | AD-20801, AD-20800 |
| 1701 | CCAUCUCCCUGC | 2633 | GCAGGGAGAUGG | 3182 | AD-20801, AD-20800 |
| 1702 | CAUCUCCCUGCU | 2634 | AGCAGGGAGAUG | 3183 | AD-20801, AD-20800 |
| 1703 | AUCUCCCUGCUG | 2635 | CAGCAGGGAGAU | 3184 | AD-20801, AD-20800 |
| 1704 | UCUCCCUGCUGA | 2636 | UCAGCAGGGAGA | 3185 | AD-20801, AD-20800 |
| 1705 | CUCCCUGCUGAC | 2637 | GUCAGCAGGGAG | 3186 | AD-20801, AD-20800 |
| 2009 | CAGGUUGUUCAU | 2638 | AUGAACAACCUG | 3187 | AD-20279, AD-20278 |
| 2010 | AGGUUGUUCAUA | 2639 | UAUGAACAACCU | 3188 | AD-20279, AD-20280 |
| 2011 | GGUUGUUCAUAG | 2640 | CUAUGAACAACC | 3189 | AD-20279, AD-20278 |
| 2012 | GUUGUUCAUAGU | 2641 | ACUAUGAACAAC | 3190 | AD-20279, AD-20280 |
| 2013 | UUGUUCAUAGUC | 2642 | GACUAUGAACAA | 3191 | AD-20279, AD-20278 |
| 2014 | UGUUCAUAGUCA | 2643 | UGACUAUGAACA | 3192 | AD-20279, AD-20280 |
| 2015 | GUUCAUAGUCAG | 2644 | CUGACUAUGAAC | 3193 | AD-20279, AD-20278 |
| 2016 | UUCAUAGUCAGA | 2645 | UCUGACUAUGAA | 3194 | AD-20279, AD-20280 |

Example 2

Preparation of siRNAs

Small scale synthesis is used to prepare HSF1 siRNAs; medium and large scale syntheses can also be used to prepare these siRNAs in larger quantities.

Small Scale Synthesis and Purification Methods for the Initial Screens (1 μmole Scale).

Small scale synthesis is used to generate siRNAs.

HSF1 sequences are synthesized on MerMade 192 synthesizer (BioAutomation, Plano, Tex.) at 1 μmol scale.

For all the sequences in the list, 'endolight' chemistry is applied as detailed below:

All pyrimidines (cytosine and uridine) in the sense strand contain 2'-O-Methyl bases (2' O-Methyl C and 2'-O-Methyl U).

In the antisense strand, pyrimidines adjacent to (towards 5' position) ribo A nucleoside are replaced with their corresponding 2-O-Methyl nucleosides.

A two base dTdT extension at 3' end of both sense and antisense sequences is introduced.

The sequence file is converted to a text file to make it compatible for loading in the MerMade 192 synthesis software.

Synthesis, Cleavage and Deprotection

The synthesis of HSF1 sequences can use solid supported oligonucleotide synthesis using phosphoramidite chemistry.

The synthesis of the above sequences is performed at 1 um scale in 96 well plates. The ribo and 2-O-Methyl phosphoramidite solutions are prepared at 0.1M concentration and ethyl thio tetrazole (0.6M in Acetonitrile) is used as activator. Deblock solution, oxidizer solution and capping solution are prepared according to standard processes.

The synthesized sequences are cleaved and deprotected in 96 well plates, using methylamine solution (a 3:1 mixture of aqueous and ethanolic solutions) in the first step and fluoride reagent in the second step. The crude sequences are precipitated using acetone:ethanol (80:20) mix and the pellet are re-suspended in 0.02M sodium acetate buffer. Samples from each sequence are analyzed by LC-MS to confirm the identity, UV for quantification and a selected set of samples by IEX chromatography to determine purity.

Purification and Desalting

HSF1 tiled sequences are purified on AKTA explorer purification system using Source 15Q column. A column temperature of 65 C is maintained during purification. Sample injection and collection are performed in 96 well (1.8 mL-deep well) plates. A single peak corresponding to the full length sequence is collected in the eluent. The purified sequences are desalted on a Sephadex G25 column using AKTA purifier. The concentration of desalted HSF1 sequences are calculated using absorbance at 260 nm wavelength and purity was measured by ion exchange chromatography.

Annealing

Purified desalted sense and antisense single strands are mixed in equimolar amounts and annealed to form HSF1 duplexes. The duplexes are prepared at 10 uM concentration in 1×PBS buffer and tested by capillary gel electrophoresis for purity.

Medium Scale Synthesis and Purification (1-50 μmol)

Medium scale synthesis can also be used to generate siRNAs.

Single-stranded RNAs in scales between 1 and 50 μmol are prepared by solid phase synthesis using an ABI DNA/RNA Synthesizer 394 (Applied Biosystems) and controlled pore glass (CPG, 500 Å, loading 80-100 μmol/g) purchased from Prime Synthesis (Aston, Pa.) as the solid support. For larger scales, empty synthesis columns (10 mmol) from Glen Research Corp. and large amidite (80 mL) and reagent bottles (450 mL) are used. RNA and RNA containing 2'-O-methyl nucleotides are generated by solid phase synthesis employing the corresponding phosphoramidites and 2'-O-methyl phosphoramidites, respectively (ChemGenes, Wilmington, Mass.). These building blocks are incorporated at selected sites within the sequence of the oligoribonucleotide chain using standard nucleoside phosphoramidite chemistry such as described in Current Protocols in Nucleic Acid Chemistry, Beaucage, S. L. et al. (Edrs.), John Wiley & Sons, Inc., New York, N.Y., USA. Phosphorothioate linkages are introduced using a solution of the 0.1 M DDTT (AM Chemicals, Oceanside, Calif.) in pyridine. Further ancillary reagents are obtained from Glen Research Corp. (Sterling, Va.).

Deprotection and purification of the crude oligoribonucleotides by anion exchange HPLC are carried out according to established procedures. Yields and concentrations are determined spectrophotometrically at a wavelength of 260 nm. Double stranded RNA is generated by mixing an equimolar solution of complementary strands in annealing buffer (typically phosphate buffered solution, PBS, Ambion, Applied Biosystems, Austin, Tex.) at the desired concentration. The mixture is then heated in a water bath at 85-90° C. for 5 minutes and cooled to room temperature over a period of 3-4 hours. The RNA duplex is stored at −20° C. until use.

Example 3

HSF1 RNAi Agents

HSF1 siRNAs are provided in Table 2, and prepared as described in Example 2. The activity of these RNAi agents is listed in Table 4.

Table 4 indicates the residual level of HSF1 expression in approximately 20,000 WI38 or HeLa cells treated with 10 nM of the indicated siRNA. Expression measurements are done 24 hours after transfection. Expression is measured using RT-qRT [real-time quantitative reverse transcription]. The residual activity is normalized to HSF1 expression in Luc siRNA transfected cells, and 1.000000=100% gene expression relative to the control, or no or 0% gene knockdown; and 0.000000=0% gene expression, or complete or 100% gene knockdown in WI38 or HeLa cells. A low number (closer to zero) indicates a more potent siRNA. For example, the "WI38" column for siRNA AD-20303 indicates "0.056232" meaning that the residual gene activity is 5.6%, or 94.4% gene knock-down at 10 nM. In the HeLa column, "0.098871432" indicates approximately 9.9% residual activity, or 90.1% gene knockdown at 10 nM.

A serial dilution of the siRNAs was performed and the data curve fit to calculate the dose (concentration) required to knock down gene expression by 50% ("EC50," or effective concentration estimated to reduce gene expression by 50%). The "EC50 Average" indicates the amount of siRNA in nM in which 50% gene knockdown is expected to be achieved; the given number is an average of two experiments. A lower number indicates a more potent siRNA. A blank cell indicates that no siRNA with that sequence was tested in that particular test, or that such data is not included herein.

In Table 4, the suffixes "-b1", "-b2", etc., indicate batch numbers. Thus "b1" is from batch 1, "b2" is from batch 2, etc. Thus, for example, "AD-20489-b1", "AD-20489-b2" and "AD-20489" all have the same sequence and are chemically identical.

TABLE 4

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
| --- | --- | --- | --- | --- | --- | --- |
| AD-20284 | 827 | 1350 | 1862 | 0.543633 | 1.057018041 | |
| AD-20285 | 212 | 1036 | 1548 | 0.914447 | 1.641966293 | |
| AD-20286 | 213 | 1037 | 1549 | 0.813034 | 1.375673997 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20287 | 216 | 1038 | 1550 | 0.696869 | 1.375574862 | |
| AD-20288 | 217 | 1039 | 1551 | 0.662908 | 1.198888545 | |
| AD-20289 | 218 | 1040 | 1552 | 0.862919 | 1.474587971 | |
| AD-20290 | 219 | 1041 | 1553 | 0.853455 | 1.202220643 | |
| AD-20291 | 220 | 1042 | 1554 | 0.747856 | 1.168784268 | |
| AD-20292 | 221 | 1043 | 1555 | 0.898657 | 0.972865247 | |
| AD-20293 | 222 | 1044 | 1556 | 0.824067 | 1.228130423 | |
| AD-20294 | 223 | 1045 | 1557 | 0.521985 | 0.592834658 | |
| AD-20295 | 224 | 1046 | 1558 | 0.987656 | 1.414757168 | |
| AD-20296 | 225 | 1047 | 1559 | 0.195372 | 0.369849098 | |
| AD-20297 | 226 | 1048 | 1560 | 0.635752 | 0.861551334 | |
| AD-20298 | 227 | 1049 | 1561 | 0.615987 | 1.094714334 | |
| AD-20299 | 228 | 1050 | 1562 | 0.730146 | 1.266851398 | |
| AD-20300 | 229 | 1051 | 1563 | 0.385889 | 0.479920139 | |
| AD-20301 | 230 | 1052 | 1564 | 0.553587 | 0.629050308 | |
| AD-20302 | 231 | 1053 | 1565 | 0.763571 | 1.310519322 | |
| AD-20303 | 232 | 1054 | 1566 | 0.056232 | 0.098871432 | 0.03675 |
| AD-20304 | 233 | 1055 | 1567 | 0.631087 | 1.049741901 | |
| AD-20305 | 234 | 1056 | 1568 | 0.963295 | 1.205807828 | |
| AD-20306 | 235 | 1057 | 1569 | 0.727406 | 0.806719271 | |
| AD-20307 | 236 | 1058 | 1570 | 0.959911 | 0.796014304 | |
| AD-20308 | 237 | 1059 | 1571 | 0.895564 | 1.676467495 | |
| AD-20309 | 238 | 1060 | 1572 | 0.921272 | 1.144712192 | |
| AD-20310 | 239 | 1061 | 1573 | 0.88654 | 1.038915255 | |
| AD-20311 | 240 | 1062 | 1574 | 0.722451 | 0.963062743 | |
| AD-20312 | 241 | 1063 | 1575 | 0.256473 | 0.406750757 | |
| AD-20313 | 242 | 1064 | 1576 | 0.090404 | 0.127185725 | 0.1542 |
| AD-20314 | 243 | 1065 | 1577 | 0.707532 | 0.912250883 | |
| AD-20315 | 244 | 1066 | 1578 | 0.188305 | 0.220760574 | 0.00639 |
| AD-20316 | 245 | 1067 | 1579 | 0.413665 | 0.74538006 | |
| AD-20317 | 246 | 1068 | 1580 | 0.860383 | 1.079643078 | |
| AD-20318 | 247 | 1069 | 1581 | 0.740659 | 1.017485803 | |
| AD-20319 | 270 | 1073 | 1585 | 0.725242 | 1.109809374 | |
| AD-20320 | 271 | 1074 | 1586 | 0.656347 | 0.829339468 | |
| AD-20344-b1 | 306 | 1075 | 1587 | 0.370436 | 0.484671104 | |
| AD-20345-b1 | 307 | 1076 | 1588 | 0.337813 | 0.314374139 | |
| AD-20346-b1 | 309 | 1078 | 1590 | 0.908065 | 1.342645071 | |
| AD-20347-b1 | 310 | 1079 | 1591 | 0.785716 | 1.315013835 | |
| AD-20348-b1 | 311 | 1080 | 1592 | 0.110617 | 0.173142843 | 0.78766 |
| AD-20349-b1 | 312 | 1081 | 1593 | 0.330099 | 0.600908235 | |
| AD-20350-b1 | 313 | 1082 | 1594 | 0.601169 | 0.966029148 | |
| AD-20351-b1 | 314 | 1083 | 1595 | 0.859247 | 1.015933117 | |
| AD-20352-b1 | 315 | 1084 | 1596 | 0.755786 | 0.724475428 | |
| AD-20353-b1 | 316 | 1085 | 1597 | 0.321073 | 0.349284689 | |
| AD-20354-b1 | 317 | 1086 | 1598 | 0.441617 | 0.790060291 | |
| AD-20355-b1 | 318 | 1087 | 1599 | 0.504071 | 1.043091893 | |
| AD-20356-b1 | 319 | 1088 | 1600 | 0.487357 | 0.867585579 | |
| AD-20357-b1 | 320 | 1089 | 1601 | 0.865058 | 1.366171522 | |
| AD-20358-b1 | 321 | 1090 | 1602 | 1.033327 | 1.291294086 | |
| AD-20359-b1 | 322 | 1091 | 1603 | 1.021823 | 1.235485413 | |
| AD-20360-b1 | 323 | 1092 | 1604 | 0.890403 | 1.404984726 | |
| AD-20361-b1 | 324 | 1093 | 1605 | 0.946695 | 1.257013375 | |
| AD-20362-b1 | 325 | 1094 | 1606 | 0.201283 | 0.252614379 | 0.8636 |
| AD-20363-b1 | 326 | 1095 | 1607 | 0.727406 | 1.284936927 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20364-b1 | 327 | 1096 | 1608 | 0.16427 | 0.23101335 | 0.07445 |
| AD-20365-b1 | 328 | 1097 | 1609 | 0.155749 | 0.128088832 | 0.0134 |
| AD-20366-b1 | 329 | 1098 | 1610 | 0.20747 | 0.172548995 | 0.26565 |
| AD-20367-b1 | 330 | 1099 | 1611 | 0.633259 | 0.801146854 | |
| AD-20368-b1 | 331 | 1100 | 1612 | 0.622818 | 1.054126591 | |
| AD-20369-b1 | 351 | 1101 | 1613 | 0.753131 | 1.069508982 | |
| AD-20370-b1 | 352 | 1102 | 1614 | 0.774695 | 0.952729539 | |
| AD-20371-b1 | 353 | 1103 | 1615 | 0.48181 | 0.942790198 | |
| AD-20372-b1 | 354 | 1104 | 1616 | 0.674589 | 1.028113827 | |
| AD-20373-b1 | 355 | 1105 | 1617 | 0.097819 | 0.104764119 | 0.02475 |
| AD-20374-b1 | 356 | 1106 | 1618 | 0.347849 | 0.543484914 | |
| AD-20375-b1 | 357 | 1107 | 1619 | 0.638399 | 0.66208024 | |
| AD-20376-b1 | 358 | 1108 | 1620 | 0.050815 | 0.067088855 | 0.00507 |
| AD-20378-b1 | 360 | 1109 | 1621 | 1.035963 | 0.966029148 | 0.61274 |
| AD-20379-b1 | 361 | 1110 | 1622 | 0.454065 | 0.572640533 | |
| AD-20380-b1 | 362 | 1111 | 1623 | 0.25276 | 0.543419645 | |
| AD-20381-b1 | 363 | 1112 | 1624 | 1.149473 | 1.660591875 | |
| AD-20382-b1 | 364 | 1113 | 1625 | 0.950581 | 1.296847343 | |
| AD-20383-b1 | 365 | 1114 | 1626 | 0.847743 | 1.278993262 | |
| AD-20384-b1 | 366 | 1115 | 1627 | 0.862049 | 1.144731035 | |
| AD-20385-b1 | 367 | 1116 | 1628 | 0.605641 | 0.829638325 | |
| AD-20386-b1 | 436 | 1117 | 1629 | 0.030203 | 0.061237298 | 0.00049 |
| AD-20387-b1 | 489 | 1139 | 1651 | 0.285437 | 0.325718495 | |
| AD-20388-b1 | 490 | 1140 | 1652 | 0.391351 | 0.505908575 | |
| AD-20389-b1 | 491 | 1141 | 1653 | 0.067492 | 0.082477169 | 0.07576 |
| AD-20390-b1 | 492 | 1142 | 1654 | 0.29646 | 0.485136885 | |
| AD-20391-b1 | 493 | 1143 | 1655 | 0.032161 | 0.06448988 | 0.00463 |
| AD-20392-b1 | 494 | 1144 | 1656 | 0.031801 | 0.093150137 | 0.04397 |
| AD-20393-b1 | 495 | 1145 | 1657 | 0.234886 | 0.390040961 | |
| AD-20394-b1 | 496 | 1146 | 1658 | 0.904297 | 1.574701063 | |
| AD-20395-b1 | 497 | 1147 | 1659 | 0.17985 | 0.44820074 | |
| AD-20396-b1 | 498 | 1148 | 1660 | 0.322909 | 0.648454825 | |
| AD-20397-b1 | 499 | 1149 | 1661 | 0.109957 | 0.16678346 | 0.2323 |
| AD-20398-b1 | 500 | 1150 | 1662 | 0.139138 | 0.229318478 | 0.4807 |
| AD-20399-b1 | 501 | 1151 | 1663 | 0.067419 | 0.070581041 | 0.01757 |
| AD-20400-b1 | 502 | 1152 | 1664 | 0.487807 | 0.67402138 | |
| AD-20401-b1 | 503 | 1153 | 1665 | 0.072005 | 0.078942641 | 0.08459 |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20402-b1 | 504 | 1154 | 1666 | 0.04683 | 0.067222033 | 0.00705 |
| AD-20403-b1 | 505 | 1155 | 1667 | 0.033648 | 0.040950778 | 0.00178 |
| AD-20404-b1 | 506 | 1156 | 1668 | 0.059783 | 0.094532132 | 0.00881 |
| AD-20405-b1 | 509 | 1159 | 1671 | 1.097465 | 1.526589204 | |
| AD-20406-b1 | 510 | 1160 | 1672 | 0.104731 | 0.262088429 | 0.00878 |
| AD-20407-b1 | 511 | 1161 | 1673 | 0.046705 | 0.122859215 | 0.00183 |
| AD-20408-b1 | 512 | 1162 | 1674 | 0.042965 | 0.099681042 | 0.00315 |
| AD-20409-b1 | 513 | 1163 | 1675 | 0.094698 | 0.183015108 | 0.00307 |
| AD-20410-b1 | 514 | 1164 | 1676 | 0.073099 | 0.092506702 | 0.015 |
| AD-20411-b1 | 515 | 1165 | 1677 | 0.081383 | 0.138821902 | 0.00193 |
| AD-20412-b1 | 516 | 1166 | 1678 | 0.801088 | 1.025055268 | |
| AD-20413-b1 | 517 | 2046 | 2047 | 0.1237 | 0.1888102 | |
| AD-20414-b1 | 518 | 1167 | 1679 | 0.888671 | 0.939545319 | |
| AD-20415-b1 | 519 | 1168 | 1680 | 0.776025 | 1.010748814 | |
| AD-20416-b1 | 520 | 1169 | 1681 | 0.901076 | 1.64781519 | |
| AD-20417-b1 | 521 | 1170 | 1682 | 0.906995 | 1.439357047 | |
| AD-20418-b1 | 522 | 1171 | 1683 | 0.650295 | 1.400603047 | |
| AD-20419-b1 | 523 | 1172 | 1684 | 0.922855 | 1.598754699 | |
| AD-20420-b1 | 524 | 1173 | 1685 | 0.91692 | 1.531567195 | |
| AD-20421-b1 | 525 | 1174 | 1686 | 0.31653 | 0.557463247 | |
| AD-20422-b1 | 526 | 1175 | 1687 | 0.059576 | 0.093484193 | 0.00157 |
| AD-20423-b1 | 527 | 1176 | 1688 | 0.657285 | 0.921602755 | |
| AD-20424-b1 | 528 | 1177 | 1689 | 0.711614 | 0.570505181 | |
| AD-20425-b1 | 529 | 1178 | 1690 | 1.020643 | 0.990138123 | |
| AD-20426-b1 | 530 | 1179 | 1691 | 0.200208 | 0.311228942 | |
| AD-20427-b1 | 531 | 1180 | 1692 | 0.364599 | 0.453759578 | |
| AD-20428-b1 | 532 | 1181 | 1693 | 0.131633 | 0.289178993 | 1.4762 |
| AD-20429-b1 | 533 | 1182 | 1694 | 0.481253 | 0.633425699 | |
| AD-20430-b1 | 534 | 1183 | 1695 | 0.8211 | 1.641493076 | |
| AD-20431-b1 | 535 | 1184 | 1696 | 0.404548 | 1.049716684 | |
| AD-20432-b1 | 536 | 1185 | 1697 | 0.494569 | 0.752912672 | |
| AD-20433-b1 | 537 | 1186 | 1698 | 0.308767 | 0.465128645 | |
| AD-20434-b1 | 538 | 1187 | 1699 | 0.076144 | 0.129485841 | 0.00334 |
| AD-20435-b1 | 539 | 1188 | 1700 | 0.039875 | 0.072404187 | 0.00036 |
| AD-20436-b1 | 540 | 1189 | 1701 | 0.167895 | 0.377674844 | |
| AD-20437-b1 | 541 | 1190 | 1702 | 0.031574 | 0.064053646 | |
| AD-20438-b1 | 542 | 1191 | 1703 | 0.026509 | 0.059755553 | 0.00007 |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20439-b1 | 543 | 1192 | 1704 | 0.085946 | 0.113834413 | 0.0002 |
| AD-20487-b1 | 544 | 1193 | 1705 | 0.024337 | 0.060353389 | |
| AD-20488-b1 | 545 | 1194 | 1706 | 0.035714 | 0.070358389 | 0.00016 |
| AD-20489-b1 | 546 | 1195 | 1707 | 0.030331 | 0.057370933 | <1E−05 |
| AD-20490-b1 | 547 | 1196 | 1708 | 0.0329 | 0.08714602 | 0.00021 |
| AD-20491-b1 | 548 | 1197 | 1709 | 0.034581 | 0.076846617 | 0.00004 |
| AD-20492-b1 | 549 | 1198 | 1710 | 0.407597 | 0.338288586 | |
| AD-20493-b1 | 550 | 1199 | 1711 | 0.036567 | 0.094916679 | 0.00196 |
| AD-20494-b1 | 579 | 1200 | 1712 | 0.251648 | 0.336937859 | |
| AD-20495-b1 | 580 | 1201 | 1713 | 0.073028 | 0.095448495 | 0.0207 |
| AD-20496-b1 | 581 | 1202 | 1714 | 0.619868 | 0.676154345 | |
| AD-20497-b1 | 582 | 1203 | 1715 | 0.870069 | 0.843820864 | |
| AD-20498-b1 | 583 | 1204 | 1716 | 0.711631 | 1.244198436 | |
| AD-20499-b1 | 584 | 1205 | 1717 | 0.864557 | 1.565852803 | |
| AD-20500-b1 | 585 | 1206 | 1718 | 0.590666 | 1.156715971 | |
| AD-20501-b1 | 586 | 1207 | 1719 | 0.321833 | 0.63913362 | |
| AD-20502-b1 | 587 | 1208 | 1720 | 0.085336 | 0.255995345 | 0.01974 |
| AD-20503-b1 | 588 | 1209 | 1721 | 0.699393 | 1.425281914 | |
| AD-20504-b1 | 589 | 1210 | 1722 | 0.375606 | 0.858565436 | |
| AD-20505-b1 | 590 | 1211 | 1723 | 0.811959 | 1.357125789 | |
| AD-20506-b1 | 591 | 1212 | 1724 | 0.372207 | 0.80389444 | |
| AD-20507-b1 | 592 | 1213 | 1725 | 0.032835 | 0.069589269 | 0.22784 |
| AD-20508-b1 | 593 | 1214 | 1726 | 0.617356 | 1.083293756 | |
| AD-20509-b1 | 594 | 1215 | 1727 | 1.067763 | 1.559741673 | |
| AD-20510-b1 | 595 | 1216 | 1728 | 0.229914 | 0.368671667 | |
| AD-20511-b1 | 596 | 1217 | 1729 | 0.254225 | 0.637831523 | |
| AD-20512-b1 | 597 | 1218 | 1730 | 0.410688 | 0.672742156 | |
| AD-20513-b1 | 598 | 1219 | 1731 | 0.074327 | 0.152299691 | 0.09514 |
| AD-20514-b1 | 660 | 1220 | 1732 | 0.814998 | 1.553693251 | |
| AD-20515-b1 | 661 | 1221 | 1733 | 0.754914 | 1.032432979 | |
| AD-20516-b1 | 662 | 1222 | 1734 | 0.757584 | 1.275663046 | |
| AD-20517-b1 | 663 | 1223 | 1735 | 0.907344 | 0.937222684 | |
| AD-20518-b1 | 664 | 1224 | 1736 | 0.606761 | 0.859343664 | |
| AD-20519-b1 | 665 | 1225 | 1737 | 0.958802 | 1.352308689 | |
| AD-20520-b1 | 666 | 1226 | 1738 | 1.027619 | 1.548903545 | |
| AD-20521-b1 | 667 | 1227 | 1739 | 1.041889 | 1.298156014 | |
| AD-20522-b1 | 668 | 1228 | 1740 | 1.263989 | 1.229374539 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20523-b1 | 669 | 1229 | 1741 | 0.975755 | 1.708883973 | |
| AD-20524-b1 | 670 | 1230 | 1742 | 0.910412 | 1.363879889 | |
| AD-20525-b1 | 671 | 1231 | 1743 | 0.992543 | 1.746803026 | |
| AD-20526-b1 | 672 | 1232 | 1744 | 0.956605 | 0.951954008 | |
| AD-20527-b1 | 673 | 1233 | 1745 | 0.188065 | 0.228063688 | 0.06117 |
| AD-20528-b1 | 674 | 1234 | 1746 | 0.817921 | 0.925922775 | |
| AD-20529-b1 | 675 | 1235 | 1747 | 0.926409 | 1.446572494 | |
| AD-20530-b1 | 676 | 1236 | 1748 | 0.373532 | 0.18718473 | |
| AD-20531-b1 | 677 | 1237 | 1749 | 0.471349 | 0.223370205 | |
| AD-20532-b1 | 678 | 1238 | 1750 | 1.404848 | 1.377927517 | |
| AD-20533-b1 | 679 | 1239 | 1751 | 1.285181 | 1.422003002 | |
| AD-20534-b1 | 680 | 1240 | 1752 | 0.634896 | 0.56546462 | |
| AD-20535-b1 | 681 | 1241 | 1753 | 0.174661 | 0.148940901 | 0.29242 |
| AD-20536-b1 | 682 | 1242 | 1754 | 0.803392 | 0.89969547 | |
| AD-20537-b1 | 683 | 1243 | 1755 | 0.855147 | 1.158722144 | |
| AD-20538-b1 | 684 | 1244 | 1756 | 0.444431 | 0.500867185 | |
| AD-20539-b1 | 685 | 1245 | 1757 | 0.879273 | 1.162891581 | |
| AD-20540-b1 | 690 | 1250 | 1762 | 0.989234 | 1.313170683 | |
| AD-20541-b1 | 691 | 1251 | 1763 | 0.897878 | 1.030119632 | |
| AD-20542-b1 | 692 | 1252 | 1764 | 0.481253 | 0.434545147 | |
| AD-20543-b1 | 693 | 1253 | 1765 | 0.864557 | 0.511391469 | |
| AD-20544-b1 | 694 | 1254 | 1766 | 0.174857 | 0.052921675 | 0.00594 |
| AD-20545-b1 | 695 | 1255 | 1767 | 0.071577 | 0.047121676 | 0.00711 |
| AD-20546-b1 | 696 | 1256 | 1768 | 0.16775 | 0.147475595 | 0.2047 |
| AD-20547-b1 | 697 | 1257 | 1769 | 0.192017 | 0.135189447 | 0.03551 |
| AD-20548-b2 | 698 | 1258 | 1770 | 0.181681 | 0.217307804 | 0.00061 |
| AD-20549-b1 | 699 | 1259 | 1771 | 0.198941 | 0.143891617 | 0.1391 |
| AD-20550-b1 | 700 | 1260 | 1772 | 0.566237 | 0.542455982 | |
| AD-20551-b1 | 701 | 1261 | 1773 | 0.82361 | 1.446572494 | |
| AD-20552-b1 | 702 | 1262 | 1774 | 0.138619 | 0.128764954 | 0.08771 |
| AD-20553-b1 | 703 | 1263 | 1775 | 0.734694 | 0.767332896 | |
| AD-20554-b1 | 704 | 1264 | 1776 | 0.596327 | 0.451450159 | |
| AD-20555-b1 | 705 | 1265 | 1777 | 0.121969 | 0.126599989 | 0.02063 |
| AD-20556-b1 | 706 | 1266 | 1778 | 0.159416 | 0.071195236 | 0.00754 |
| AD-20557-b1 | 707 | 1267 | 1779 | 0.077337 | 0.04632467 | 0.00082 |
| AD-20558-b1 | 731 | 1291 | 1803 | 0.156539 | 0.093590117 | 0.07236 |
| AD-20559-b1 | 732 | 1292 | 1804 | 0.30349 | 0.280860279 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20560-b2 | 733 | 1293 | 1805 | 0.323181 | 0.206972165 | <1E-05 |
| AD-20561-b1 | 734 | 1294 | 1806 | 0.099423 | 0.07673151 | 0.02383 |
| AD-20562-b1 | 735 | 1295 | 1807 | 0.039811 | 0.042199399 | 0.00048 |
| AD-20563-b2 | 736 | 1296 | 1808 | 0.123696 | 0.188810207 | 0.00004 |
| AD-20564-b2 | 737 | 1297 | 1809 | 0.448939 | 0.206972165 | <1E-05 |
| AD-20565-b1 | 738 | 1298 | 1810 | 0.060827 | 0.055264621 | 0.01163 |
| AD-20566-b2 | 739 | 1299 | 1811 | 0.228259 | 0.203420172 | 0.00268 |
| AD-20567-b1 | 740 | 1300 | 1812 | 0.852163 | 0.397272737 | |
| AD-20568-b1 | 741 | 1301 | 1813 | 0.975474 | 1.06284006 | |
| AD-20569-b1 | 742 | 1302 | 1814 | 1.038248 | 1.70257293 | |
| AD-20571-b1 | 744 | 1303 | 1815 | 0.914379 | 0.887564894 | |
| AD-20572-b1 | 745 | 1304 | 1816 | 0.07702 | 0.047860345 | 0.06155 |
| AD-20573-b1 | 746 | 1305 | 1817 | 0.630783 | 0.659280255 | |
| AD-20574-b1 | 747 | 2048 | 2049 | 0.22826 | 0.2034202 | 1.37204 |
| AD-20575-b1 | 748 | 1306 | 1818 | 0.124712 | 0.101746738 | 0.13506 |
| AD-20576-b1 | 749 | 1307 | 1819 | 0.329885 | 0.232889354 | |
| AD-20577-b1 | 750 | 1308 | 1820 | 0.223627 | 0.133103976 | 0.08248 |
| AD-20578-b1 | 751 | 1309 | 1821 | 0.061816 | 0.066873479 | 0.00043 |
| AD-20579-b1 | 752 | 1310 | 1822 | 0.264159 | 0.12924691 | 0.10334 |
| AD-20581-b1 | 754 | 1311 | 1823 | 0.513809 | 0.48572165 | |
| AD-20582-b1 | 755 | 1312 | 1824 | 0.389395 | 0.399959136 | |
| AD-20625-b1 | 756 | 1313 | 1825 | 0.256936 | 0.116433489 | 0.01077 |
| AD-20626-b1 | 757 | 1314 | 1826 | 0.087123 | 0.081492545 | 0.00028 |
| AD-20627-b1 | 758 | 1315 | 1827 | 0.055328 | 0.055650353 | |
| AD-20628-b1 | 759 | 1316 | 1828 | 0.447781 | 0.303068664 | |
| AD-20629-b1 | 760 | 1317 | 1829 | 0.234948 | 0.307299345 | |
| AD-20630-b1 | 761 | 1318 | 1830 | 0.489721 | 0.223370205 | |
| AD-20631-b1 | 762 | 1319 | 1831 | 0.653686 | 0.400035988 | |
| AD-20632-b1 | 763 | 1320 | 1832 | 0.770776 | 0.563518413 | |
| AD-20633-b1 | 781 | 1321 | 1833 | 0.19814 | 0.117243348 | 0.04183 |
| AD-20634-b1 | 799 | 1322 | 1834 | 0.112208 | 0.080929635 | 0.0041 |
| AD-20635-b1 | 800 | 1323 | 1835 | 0.415981 | 0.277900171 | |
| AD-20636-b1 | 801 | 1324 | 1836 | 0.935782 | 0.977777409 | |
| AD-20637-b1 | 802 | 1325 | 1837 | 0.867293 | 0.869090293 | |
| AD-20638-b1 | 803 | 1326 | 1838 | 0.26502 | 0.374396441 | |
| AD-20639-b1 | 804 | 1327 | 1839 | 0.283056 | 0.375662409 | |
| AD-20640-b1 | 805 | 1328 | 1840 | 0.057288 | 0.069780308 | 0.00527 |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20641-b1 | 806 | 1329 | 1841 | 0.533881 | 0.623267984 | |
| AD-20642-b1 | 807 | 1330 | 1842 | 0.460005 | 0.389433419 | |
| AD-20643-b1 | 808 | 1331 | 1843 | 0.315391 | 0.221106278 | |
| AD-20644-b1 | 809 | 1332 | 1844 | 0.109044 | 0.131007072 | 0.00111 |
| AD-20645-b1 | 810 | 1333 | 1845 | 1.128482 | 0.998274628 | |
| AD-20646-b1 | 811 | 1334 | 1846 | 0.095785 | 0.066873479 | 0.00008 |
| AD-20647-b1 | 812 | 1335 | 1847 | 1.156048 | 0.143850149 | |
| AD-20648-b1 | 813 | 1336 | 1848 | 0.106528 | 0.109039633 | 0.00115 |
| AD-20649-b1 | 814 | 1337 | 1849 | 0.706715 | 1.084879386 | |
| AD-20650-b1 | 815 | 1338 | 1850 | 0.171848 | 0.255734126 | 0.02769 |
| AD-20651-b1 | 816 | 1339 | 1851 | 0.611334 | 0.869126829 | |
| AD-20652-b2 | 817 | 1340 | 1852 | 0.143195 | 0.207349809 | 0.00003 |
| AD-20653-b1 | 818 | 1341 | 1853 | 0.193334 | 0.079856194 | 0.00532 |
| AD-20654-b1 | 819 | 1342 | 1854 | 0.75582 | 1.143572737 | |
| AD-20655-b1 | 820 | 1343 | 1855 | 0.858399 | 1.313052418 | |
| AD-20656-b1 | 821 | 1344 | 1856 | 0.541334 | 0.428549767 | |
| AD-20657-b1 | 822 | 1345 | 1857 | 0.741904 | 0.863123331 | |
| AD-20658-b1 | 823 | 1346 | 1858 | 0.198178 | 0.475597123 | |
| AD-20659-b1 | 824 | 1347 | 1859 | 0.388124 | 0.491623427 | |
| AD-20660-b1 | 825 | 1348 | 1860 | 0.077439 | 0.077627767 | 0.00955 |
| AD-20661-b1 | 826 | 1349 | 1861 | 0.156255 | 0.137512877 | 0.28191 |
| AD-20662-b1 | 847 | 1351 | 1863 | 0.476044 | 0.505032662 | |
| AD-20663-b1 | 849 | 1353 | 1865 | 0.600475 | 0.625882515 | |
| AD-20664-b1 | 850 | 1354 | 1866 | 0.652588 | 1.119554306 | |
| AD-20665-b1 | 851 | 1355 | 1867 | 0.714432 | 1.029952624 | |
| AD-20666-b1 | 852 | 1356 | 1868 | 0.864059 | 1.029903142 | |
| AD-20667-b1 | 853 | 1357 | 1869 | 0.913326 | 1.426528593 | |
| AD-20668-b1 | 854 | 1358 | 1870 | 1.060234 | 1.57734692 | |
| AD-20669-b1 | 855 | 1359 | 1871 | 1.067968 | 1.588470861 | |
| AD-20670-b1 | 856 | 1360 | 1872 | 0.534446 | 0.427490356 | |
| AD-20671-b1 | 857 | 1361 | 1873 | 0.134052 | 0.089804062 | 0.02226 |
| AD-20672-b1 | 858 | 1362 | 1874 | 0.256251 | 0.37063074 | |
| AD-20673-b1 | 859 | 1363 | 1875 | 0.768658 | 1.062935788 | |
| AD-20674-b1 | 860 | 1364 | 1876 | 0.619496 | 0.691770914 | |
| AD-20675-b1 | 861 | 1365 | 1877 | 1.067506 | 1.213141054 | |
| AD-20676-b1 | 862 | 1366 | 1878 | 0.359737 | 0.305314129 | |
| AD-20677-b1 | 915 | 1373 | 1885 | 0.870382 | 1.317223358 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20678-b1 | 965 | 1385 | 1897 | 0.326325 | 0.270354544 | |
| AD-20679-b1 | 966 | 1386 | 1898 | 0.962322 | 1.769753135 | |
| AD-20680-b1 | 967 | 1387 | 1899 | 0.948845 | 1.697660683 | |
| AD-20681-b1 | 968 | 1388 | 1900 | 0.798916 | 0.875277199 | |
| AD-20682-b1 | 969 | 1389 | 1901 | 1.087386 | 1.561791318 | |
| AD-20683-b1 | 970 | 1390 | 1902 | 1.110234 | 1.477899464 | |
| AD-20684-b1 | 971 | 1391 | 1903 | 0.882193 | 1.207906399 | |
| AD-20685-b1 | 972 | 1392 | 1904 | 0.8211 | 1.143298164 | |
| AD-20686-b1 | 973 | 1393 | 1905 | 0.789661 | 1.092425319 | |
| AD-20687-b1 | 974 | 1394 | 1906 | 0.768455 | 1.089410843 | |
| AD-20688-b1 | 975 | 1395 | 1907 | 0.770702 | 1.022838222 | |
| AD-20689-b1 | 976 | 1396 | 1908 | 0.771035 | 1.378134406 | |
| AD-20690-b1 | 977 | 1397 | 1909 | 0.823135 | 1.037066685 | |
| AD-20691-b1 | 978 | 1398 | 1910 | 0.831763 | 1.326512826 | |
| AD-20692-b1 | 979 | 1399 | 1911 | 0.972934 | 1.15075282 | |
| AD-20693-b1 | 1011 | 1400 | 1912 | 0.072624 | 0.091035811 | 0.00046 |
| AD-20694-b1 | 1012 | 1401 | 1913 | 0.066949 | 0.06070901 | 0.00114 |
| AD-20695-b1 | 1013 | 1402 | 1914 | 0.749807 | 0.933655977 | |
| AD-20696-b1 | 1014 | 1403 | 1915 | 1.000287 | 1.346484427 | |
| AD-20697-b1 | 1015 | 1404 | 1916 | 0.809563 | 1.359618312 | |
| AD-20698-b1 | 1016 | 1405 | 1917 | 0.592378 | 0.887325083 | |
| AD-20699-b1 | 1048 | 1406 | 1918 | 0.554944 | 0.857161303 | |
| AD-20700-b1 | 1049 | 1407 | 1919 | 0.105695 | 0.123924613 | 0.04345 |
| AD-20701-b1 | 1050 | 1408 | 1920 | 0.650858 | 0.845462044 | |
| AD-20702-b1 | 1051 | 1409 | 1921 | 0.046369 | 0.069008817 | 0.0001 |
| AD-20703-b1 | 1053 | 1411 | 1923 | 0.396451 | 0.459473782 | |
| AD-20704-b1 | 1054 | 1412 | 1924 | 0.812095 | 0.881195881 | |
| AD-20705-b1 | 1055 | 1413 | 1925 | 0.798647 | 0.971064227 | |
| AD-20706-b1 | 1329 | 1416 | 1928 | 0.405034 | 0.323806017 | |
| AD-20707-b1 | 1330 | 1417 | 1929 | 0.04357 | 0.060698804 | <1E−05 |
| AD-20709-b1 | 1332 | 1418 | 1930 | 0.13188 | 0.120544575 | 0.66004 |
| AD-20710-b1 | 1333 | 1419 | 1931 | 0.401696 | 0.366834618 | 0.00717 |
| AD-20711-b1 | 1334 | 1420 | 1932 | 0.43653 | 0.442183347 | |
| AD-20712-b1 | 1335 | 1421 | 1933 | 0.584644 | 0.928468269 | |
| AD-20713-b1 | 1336 | 1422 | 1934 | 0.289461 | 0.287688205 | |
| AD-20714-b1 | 1337 | 1423 | 1935 | 0.088346 | 0.060267944 | 0.01035 |
| AD-20715-b1 | 1338 | 1424 | 1936 | 0.741225 | 0.630689818 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20716-b1 | 1339 | 1425 | 1937 | 0.07355 | 0.074476264 | 0.00203 |
| AD-20717-b1 | 1359 | 1426 | 1938 | 0.873116 | 0.931417569 | |
| AD-20718-b1 | 1360 | 1427 | 1939 | 0.399209 | 0.291704183 | |
| AD-20719-b1 | 1361 | 1428 | 1940 | 0.887602 | 0.831002378 | |
| AD-20720-b1 | 1362 | 1429 | 1941 | 0.636085 | 0.563508261 | |
| AD-20721-b1 | 1363 | 1430 | 1942 | 0.844185 | 0.872317061 | |
| AD-20722-b1 | 1364 | 1431 | 1943 | 0.862113 | 1.431782046 | |
| AD-20723-b1 | 1365 | 1432 | 1944 | 0.842047 | 0.991468351 | |
| AD-20724-b1 | 1366 | 1433 | 1945 | 0.715633 | 0.884239241 | |
| AD-20725-b1 | 1367 | 1434 | 1946 | 0.8211 | 1.13103112 | |
| AD-20726-b1 | 1368 | 1435 | 1947 | 0.870382 | 0.99848447 | |
| AD-20727-b1 | 1369 | 1436 | 1948 | 0.839722 | 0.869231218 | |
| AD-20728-b1 | 1370 | 1437 | 1949 | 0.146011 | 0.171134401 | 0.20951 |
| AD-20729-b1 | 1371 | 1438 | 1950 | 0.842855 | 0.720731925 | |
| AD-20730-b1 | 1372 | 1439 | 1951 | 0.052245 | 0.060685683 | 0.00339 |
| AD-20731-b1 | 1373 | 1440 | 1952 | 0.719574 | 0.38625851 | |
| AD-20732-b1 | 1374 | 1441 | 1953 | 1.386744 | 1.054026625 | |
| AD-20733-b1 | 1375 | 1442 | 1954 | 1.396389 | 1.27991671 | |
| AD-20734-b1 | 1379 | 1446 | 1958 | 1.294624 | 1.275419601 | |
| AD-20735-b1 | 1380 | 1447 | 1959 | 1.209551 | 1.219180143 | |
| AD-20736-b1 | 1381 | 1448 | 1960 | 1.238102 | 1.297970725 | |
| AD-20737-b1 | 1382 | 1449 | 1961 | 1.294966 | 1.241884392 | |
| AD-20738-b1 | 1383 | 1450 | 1962 | 1.130819 | 1.018122609 | |
| AD-20739-b1 | 1384 | 1451 | 1963 | 1.166108 | 1.181930519 | |
| AD-20740-b1 | 1385 | 1452 | 1964 | 1.178614 | 0.940155929 | |
| AD-20741-b1 | 1386 | 1453 | 1965 | 0.079687 | 0.065054016 | 0.00064 |
| AD-20742-b1 | 1387 | 1454 | 1966 | 1.391533 | 1.415064673 | |
| AD-20743-b1 | 1407 | 1455 | 1967 | 0.29152 | 0.304315297 | |
| AD-20744-b1 | 1408 | 1456 | 1968 | 0.908655 | 0.79362811 | |
| AD-20745-b1 | 1409 | 1457 | 1969 | 1.446467 | 1.335038609 | |
| AD-20746-b1 | 1410 | 1458 | 1970 | 1.170192 | 0.719886814 | |
| AD-20747-b1 | 1411 | 1459 | 1971 | 1.432098 | 1.21912157 | |
| AD-20748-b1 | 1428 | 1460 | 1972 | 0.772113 | 0.538061131 | |
| AD-20749-b1 | 1429 | 1461 | 1973 | 1.102275 | 0.893650074 | |
| AD-20750-b1 | 1430 | 1462 | 1974 | 1.194895 | 0.711852844 | |
| AD-20751-b1 | 1431 | 1463 | 1975 | 0.667424 | 0.418146571 | |
| AD-20752-b1 | 1432 | 1464 | 1976 | 1.391533 | 1.266609634 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20753-b1 | 1433 | 1465 | 1977 | 1.417073 | 0.853311991 | |
| AD-20754-b1 | 1434 | 1466 | 1978 | 0.844918 | 0.57890069 | |
| AD-20755-b1 | 1435 | 1467 | 1979 | 1.416154 | 1.696464074 | |
| AD-20756-b1 | 1436 | 1468 | 1980 | 1.836139 | 1.028732572 | |
| AD-20757-b1 | 1437 | 1469 | 1981 | 1.38232 | 1.06207192 | |
| AD-20758-b1 | 1438 | 1470 | 1982 | 1.330733 | 1.266974756 | |
| AD-20759-b1 | 1439 | 1471 | 1983 | 1.451044 | 1.325816823 | |
| AD-20760-b1 | 1440 | 1472 | 1984 | 1.130602 | 0.940268849 | |
| AD-20761-b1 | 1441 | 1473 | 1985 | 1.095795 | 0.976601567 | |
| AD-20762-b1 | 1442 | 1474 | 1986 | 1.203379 | 1.068688943 | |
| AD-20763-b1 | 1443 | 1475 | 1987 | 1.001156 | 1.036261261 | |
| AD-20764-b1 | 1444 | 1476 | 1988 | 0.118576 | 0.069158478 | 0.01035 |
| AD-20765-b1 | 1445 | 1477 | 1989 | 1.280472 | 0.649176427 | |
| AD-20766-b1 | 1446 | 1478 | 1990 | 0.859888 | 0.413525996 | |
| AD-20767-b1 | 1447 | 1479 | 1991 | 0.915437 | 0.874208876 | |
| AD-20768-b1 | 1448 | 1480 | 1992 | 1.491623 | 1.033674481 | |
| AD-20769-b1 | 1449 | 1481 | 1993 | 1.14688 | 0.779689688 | |
| AD-20770-b1 | 1450 | 1482 | 1994 | 1.026043 | 0.755677199 | |
| AD-20771-b1 | 1451 | 1483 | 1995 | 1.220002 | 1.129786315 | |
| AD-20772-b1 | 1452 | 1484 | 1996 | 1.055092 | 1.018073695 | |
| AD-20773-b1 | 1453 | 1485 | 1997 | 1.170473 | 1.035863089 | |
| AD-20774-b1 | 1454 | 1486 | 1998 | 0.848429 | 0.63553784 | |
| AD-20775-b1 | 1455 | 1487 | 1999 | 1.025895 | 0.62466094 | |
| AD-20776-b1 | 1456 | 1488 | 2000 | 1.114715 | 0.89556372 | |
| AD-20777-b1 | 1457 | 1489 | 2001 | 1.107175 | 0.712453613 | |
| AD-20778-b1 | 1458 | 1490 | 2002 | 1.138466 | 1.114392802 | |
| AD-20779-b1 | 1459 | 1491 | 2003 | 1.377165 | 0.815548171 | |
| AD-20780-b1 | 1460 | 1492 | 2004 | 1.595425 | 1.004202298 | |
| AD-20781-b1 | 1461 | 1493 | 2005 | 1.249894 | 1.014642825 | |
| AD-20782-b1 | 1462 | 1494 | 2006 | 1.130439 | 0.697841818 | |
| AD-20783-b1 | 1482 | 1495 | 2007 | 0.313756 | 0.140716947 | 0.07259 |
| AD-20784-b1 | 1483 | 1496 | 2008 | 0.372852 | 0.269030566 | |
| AD-20785-b1 | 1484 | 1497 | 2009 | 0.343143 | 0.300598832 | |
| AD-20786-b1 | 1485 | 1498 | 2010 | 0.921805 | 0.835570424 | |
| AD-20787-b1 | 1486 | 1499 | 2011 | 1.091775 | 0.749006565 | |
| AD-20788-b1 | 1487 | 1500 | 2012 | 1.080502 | 1.028732572 | |
| AD-20789-b1 | 1547 | 1515 | 2027 | 0.824563 | 0.771592653 | |

TABLE 4-continued

ACTIVITY OF HSF1 RNAi AGENTS

| Duplex Name | Position | Sense 5'-3' modified SEQ ID NO | Antisense 5'-3' modified SEQ ID NO | WI38 (10 nM) | HELA (10 nM) | EC50 average (nM)* |
|---|---|---|---|---|---|---|
| AD-20790-b1 | 1548 | 1516 | 2028 | 0.497168 | 0.351347846 | |
| AD-20791-b1 | 1549 | 1517 | 2029 | 1.37743 | 1.386042945 | |
| AD-20792-b1 | 1602 | 1518 | 2030 | 1.812166 | 0.920719325 | |
| AD-20793-b1 | 1603 | 1519 | 2031 | 1.643864 | 1.253455962 | |
| AD-20794-b1 | 1604 | 1520 | 2032 | 1.406609 | 1.102568271 | |
| AD-20795-b1 | 1605 | 1521 | 2033 | 1.25418 | 0.893349812 | |
| AD-20796-b1 | 1606 | 1522 | 2034 | 1.208246 | 1.054279832 | |
| AD-20797-b1 | 1634 | 1526 | 2038 | 1.182812 | 1.134873015 | |
| AD-20798-b1 | 1635 | 1527 | 2039 | 0.816019 | 0.877112215 | |
| AD-20799-b1 | 1636 | 1528 | 2040 | 1.637852 | 0.777034161 | |
| AD-20800-b1 | 1699 | 1530 | 3282 | 1.26722 | 1.137480645 | |
| AD-20801-b1 | 1700 | 1531 | 3283 | 0.690961 | 0.517931545 | |
| AD-20868-b1 | 848 | 1352 | 1864 | 1.043896 | 0.644316747 | |
| AD-20869-b1 | 1052 | 1410 | 1922 | 0.759026 | 0.601255433 | |
| AD-20870-b1 | 1607 | 1523 | 2035 | 0.963852 | 0.693770729 | |
| AD-20871-b1 | 1608 | 1524 | 2036 | 1.440675 | 1.47009696 | |
| AD-20872-b1 | 1633 | 1525 | 2037 | 0.988535 | 0.618366913 | |
| AD-20873-b1 | 1698 | 1529 | 2041 | 1.506987 | 0.994836178 | |

*wherein <1E−05 means less than $1 \times 10^{-5}$

Example 3A

Methodology for In Vitro Screening

Cell Culture and Transfections

WI-38 or HeLa (ATCC, Manassas, Va.) cells are grown to near confluence at 37° C. in an atmosphere of 5% $CO_2$ in RPMI or EMEM (ATCC) supplemented with 10% FBS, streptomycin, and glutamine (ATCC) before being released from the plate by trypsinization. Reverse transfection is carried out by adding 5 µl of Opti-MEM to 5 µl of siRNA duplexes per well into a 96-well plate along with 10 µl of Opti-MEM plus 0.2 µl of Lipofectamine RNAiMax per well (Invitrogen, Carlsbad Calif. cat #13778-150) and incubated at room temperature for 15 minutes. 80 µl of complete growth media without antibiotic containing $2 \times 10^4$ WI-38 cells or $2.0 \times 10^4$ Hela cells are then added. Cells are incubated for 24 hours prior to RNA purification. Experiments are performed 10 nM final duplex concentration for WI-38 cells and at 10 nM and 0.1 nM final duplex concentration for HeLa cells for each of the HSF1 siRNAs. A subset of siRNAs that showed robust silencing in the 10 nM and 0.1 nM screens are assayed over a range of concentrations from 10 nM to 0.00005M to determine their IC50.

Total RNA isolation using MagMAX-96 Total RNA Isolation Kit (Applied Biosystem, Foster City Calif., part #: AM1830).

Cells are harvested and lysed in 140 µl of Lysis/Binding Solution then mixed for 1 minute at 850 rpm using an Eppendorf Thermomixer (the mixing speed is the same throughout the process). Twenty microliters of magnetic beads and Lysis/Binding Enhancer mixture are added into cell-lysate and mixed for 5 minutes. Magnetic beads are captured using magnetic stand and the supernatant is removed without disturbing the beads. After removal of the supernatant, magnetic beads are washed with Wash Solution 1 (isopropanol added) and mixed for 1 minute. Beads are captured again and supernatant removed. Beads are then washed with 150 µl Wash Solution 2 (Ethanol added), captured and supernatant is removed. 50 ul of DNase mixture (MagMax turbo DNase Buffer and Turbo DNase) is then added to the beads and they are mixed for 10 to 15 minutes. After mixing, 100 µl of RNA Rebinding Solution is added and mixed for 3 minutes. Supernatant is removed and magnetic beads are washed again with 150 µl Wash Solution 2 and mixed for 1 minute and supernatant is removed completely. The magnetic beads are mixed for 2 minutes to dry before RNA is eluted with 50 µl of water.

cDNA synthesis is performed using ABI High capacity cDNA reverse transcription kit (Applied Biosystems, Cat #4368813) as follows: A master mix of 2 µl 10× Buffer, 0.8 µl 25×dNTPs, 2 µl Random primers, 1 µl Reverse Transcriptase, 1 µl RNase inhibitor and 3.2 µl of $H_2O$ per reaction are added into 10 µl total RNA. cDNA is generated using a Bio-Rad C-1000 or S-1000 thermal cycler (Hercules, Calif.) through the following steps: 25° C. 10 min, 37° C. 120 min, 85° C. 5 sec, 4° C. hold.

Real time PCR is performed as follows: 2 µl of cDNA are added to a master mix containing 0.5 ul GAPDH TaqMan Probe (Applied Biosystems Cat #4326317E) or 18S TaqMan Probe (Applied Biosystems Cat 44319413E), 0.5 μl HSF1 TaqMan probe (Applied Biosystems cat #HS00232134 M1) and 5 μl Roche Probes Master Mix (Roche Cat #04887301001) in a total of 10 μl per well in a LightCycler 480 384 well plate (Roche cat #0472974001). Real time PCR is done in a LightCycler 480 Real Time PCR machine (Roche). Each duplex is tested in at least two independent transfections. Each transfection is assayed in duplicate.

Real time data are analyzed using the ΔΔCt method (Livak et al 2001). Each sample is normalized to GAPDH expression and knockdown is assessed relative to cells transfected with the non-targeting duplex AD-1955. IC50s are defined using a 4 parameter fit model in XLfit. See e.g., Kenneth and Schmittge. Methods 25:4, December 2001, 402-408.

Example 4

HSF1 siRNAs

As shown in Table 5, a subset of 101 HSF1 RNAi agents is presented.

Many of the 101 selected duplexes had >80% gene knockdown (KD) in both HeLa and WI-38 cell lines at 10 nM. Also included in the 101 are duplexes that had >80% KD in a single cell line, provided that the average KD of the two lines is >75% KD. This set also includes all duplexes that have >50% KD in WI-38 in the 0.1 nM screen. These 101 HSF1 siRNAs of particular interest are shown in Table 2. This table also presents the knockdown (KD) in HeLa and WI-38 cells when 10 nM or 0.1 nM of siRNA was used. 1.000=100% gene expression, or no or 0% gene knockdown; and 0.000=0% gene expression, or complete or 100% gene knockdown. For example, for AD-20303, the "HeLa 10 nM" column indicates "0.099", meaning that at this concentration in these cells, the RNAi agent reduced gene expression to 9.9%, or exhibited 90.1% gene knockdown. In WI-38 cells at a concentration of 10 nM, this RNAi agent exhibited 5.6% residual gene activity, or 94.4% gene knockdown.

TABLE 5

HSF1 RNAi agents - Knock Down Data.

| | Duplex | HeLa 10 nM | WI-38 10 nM | Average (10 nM) | WI-38 0.1 nM |
|---|---|---|---|---|---|
| 1 | AD-20303 | 0.099 | 0.056 | 0.078 | 0.529 |
| 2 | AD-20313 | 0.127 | 0.090 | 0.109 | 0.884 |
| 3 | AD-20315 | 0.221 | 0.188 | 0.205 | 0.759 |
| 4 | AD-20348-b1 | 0.173 | 0.111 | 0.142 | 0.805 |
| 5 | AD-20362-b1 | 0.253 | 0.201 | 0.227 | 0.759 |
| 6 | AD-20364-b1 | 0.231 | 0.164 | 0.198 | 0.903 |
| 7 | AD-20365-b1 | 0.128 | 0.156 | 0.142 | 0.738 |
| 8 | AD-20366-b1 | 0.173 | 0.207 | 0.190 | 0.802 |
| 9 | AD-20373-b1 | 0.105 | 0.098 | 0.101 | 0.825 |
| 10 | AD-20376-b1 | 0.067 | 0.051 | 0.059 | 0.656 |
| 11 | AD-20377-b1 | 0.207 | 0.143 | 0.175 | 0.848 |
| 12 | AD-20386-b1 | 0.061 | 0.030 | 0.046 | 0.379 |
| 13 | AD-20389-b1 | 0.082 | 0.067 | 0.075 | 0.802 |
| 14 | AD-20391-b1 | 0.064 | 0.032 | 0.048 | 0.415 |
| 15 | AD-20392-b1 | 0.093 | 0.032 | 0.062 | 0.448 |
| 16 | AD-20397-b1 | 0.167 | 0.110 | 0.138 | 0.862 |
| 17 | AD-20398-b1 | 0.229 | 0.139 | 0.184 | 0.998 |
| 18 | AD-20399-b1 | 0.071 | 0.067 | 0.069 | 0.658 |
| 19 | AD-20401-b1 | 0.079 | 0.072 | 0.075 | 0.883 |
| 20 | AD-20402-b1 | 0.067 | 0.047 | 0.057 | 0.476 |
| 21 | AD-20403-b1 | 0.041 | 0.034 | 0.037 | 0.462 |
| 22 | AD-20404-b1 | 0.095 | 0.060 | 0.077 | 0.695 |
| 23 | AD-20406-b1 | 0.262 | 0.105 | 0.183 | 0.655 |
| 24 | AD-20407-b1 | 0.123 | 0.047 | 0.085 | 0.589 |
| 25 | AD-20408-b1 | 0.100 | 0.043 | 0.071 | 0.540 |
| 26 | AD-20409-b1 | 0.183 | 0.095 | 0.139 | 0.653 |
| 27 | AD-20410-b1 | 0.093 | 0.073 | 0.083 | 0.748 |
| 28 | AD-20411-b1 | 0.139 | 0.081 | 0.110 | 0.669 |
| 29 | AD-20413-b1 | 0.189 | 0.124 | 0.156 | 0.687 |
| 30 | AD-20422-b1 | 0.093 | 0.060 | 0.077 | 0.392 |
| 31 | AD-20428-b1 | 0.289 | 0.132 | 0.210 | 0.865 |
| 32 | AD-20434-b1 | 0.129 | 0.076 | 0.103 | 0.547 |
| 33 | AD-20435-b1 | 0.072 | 0.040 | 0.056 | 0.375 |
| 34 | AD-20437-b1 | 0.064 | 0.032 | 0.048 | 0.245 |
| 35 | AD-20438-b1 | 0.060 | 0.027 | 0.043 | 0.477 |
| 36 | AD-20439-b1 | 0.114 | 0.086 | 0.100 | 0.387 |
| 37 | AD-20487-b1 | 0.060 | 0.024 | 0.042 | 0.122 |
| 38 | AD-20488-b1 | 0.070 | 0.036 | 0.053 | 0.480 |
| 39 | AD-20489-b1 | 0.057 | 0.030 | 0.044 | 0.205 |
| 40 | AD-20490-b1 | 0.087 | 0.033 | 0.060 | 0.308 |
| 41 | AD-20491-b1 | 0.077 | 0.035 | 0.056 | 0.259 |
| 42 | AD-20493-b1 | 0.095 | 0.037 | 0.066 | 0.512 |
| 43 | AD-20495-b1 | 0.095 | 0.073 | 0.084 | 0.690 |
| 44 | AD-20502-b1 | 0.256 | 0.085 | 0.171 | 0.753 |
| 45 | AD-20507-b1 | 0.070 | 0.033 | 0.051 | 0.250 |
| 46 | AD-20513-b1 | 0.152 | 0.074 | 0.113 | 0.804 |
| 47 | AD-20527-b1 | 0.228 | 0.188 | 0.208 | 0.861 |
| 48 | AD-20535-b1 | 0.149 | 0.175 | 0.162 | 1.034 |
| 49 | AD-20544-b1 | 0.053 | 0.175 | 0.114 | 0.955 |
| 50 | AD-20545-b1 | 0.047 | 0.072 | 0.059 | 0.667 |
| 51 | AD-20546-b1 | 0.147 | 0.168 | 0.158 | 0.840 |
| 52 | AD-20547-b1 | 0.135 | 0.192 | 0.164 | 0.886 |
| 53 | AD-20548-b1 | 0.040 | 0.041 | 0.040 | 0.383 |
| 54 | AD-20549-b1 | 0.144 | 0.199 | 0.171 | 0.864 |
| 55 | AD-20552-b1 | 0.129 | 0.139 | 0.134 | 0.790 |
| 56 | AD-20555-b1 | 0.127 | 0.122 | 0.124 | 0.709 |
| 57 | AD-20556-b1 | 0.071 | 0.159 | 0.115 | 0.786 |
| 58 | AD-20557-b1 | 0.046 | 0.077 | 0.062 | 0.678 |
| 59 | AD-20558-b1 | 0.094 | 0.157 | 0.125 | 0.840 |
| 60 | AD-20560-b1 | 0.036 | 0.035 | 0.036 | 0.295 |
| 61 | AD-20561-b1 | 0.077 | 0.099 | 0.088 | 0.752 |
| 62 | AD-20562-b1 | 0.042 | 0.040 | 0.041 | 0.556 |
| 63 | AD-20563-b1 | 0.027 | 0.028 | 0.027 | 0.471 |
| 64 | AD-20564-b1 | 0.029 | 0.028 | 0.028 | 0.222 |
| 65 | AD-20565-b1 | 0.055 | 0.061 | 0.058 | 0.547 |
| 66 | AD-20566-b1 | 0.027 | 0.043 | 0.035 | 0.598 |
| 67 | AD-20572-b1 | 0.048 | 0.077 | 0.062 | 0.855 |
| 68 | AD-20574-b1 | 0.203 | 0.228 | 0.216 | 0.926 |
| 69 | AD-20575-b1 | 0.102 | 0.125 | 0.113 | 0.907 |
| 70 | AD-20577-b1 | 0.133 | 0.224 | 0.178 | 0.837 |
| 71 | AD-20578-b1 | 0.067 | 0.062 | 0.064 | 0.371 |
| 72 | AD-20579-b1 | 0.129 | 0.264 | 0.197 | 0.826 |
| 73 | AD-20625-b1 | 0.116 | 0.257 | 0.187 | 0.942 |
| 74 | AD-20626-b1 | 0.081 | 0.087 | 0.084 | 0.929 |
| 75 | AD-20627-b1 | 0.056 | 0.055 | 0.055 | 0.698 |
| 76 | AD-20633-b1 | 0.117 | 0.198 | 0.158 | 0.882 |
| 77 | AD-20634-b1 | 0.081 | 0.112 | 0.097 | 0.955 |
| 78 | AD-20640-b1 | 0.070 | 0.057 | 0.064 | 0.972 |
| 79 | AD-20644-b1 | 0.131 | 0.109 | 0.120 | 0.590 |
| 80 | AD-20646-b1 | 0.067 | 0.096 | 0.081 | 0.739 |
| 81 | AD-20648-b1 | 0.109 | 0.107 | 0.108 | 0.906 |
| 82 | AD-20650-b1 | 0.256 | 0.172 | 0.214 | 1.204 |
| 83 | AD-20652-b1 | 0.037 | 0.029 | 0.033 | 0.371 |
| 84 | AD-20653-b1 | 0.080 | 0.193 | 0.137 | 1.286 |
| 85 | AD-20660-b1 | 0.078 | 0.077 | 0.078 | 1.097 |
| 86 | AD-20661-b1 | 0.138 | 0.156 | 0.147 | 1.368 |
| 87 | AD-20671-b1 | 0.090 | 0.134 | 0.112 | 1.127 |
| 88 | AD-20693-b1 | 0.091 | 0.073 | 0.082 | 0.515 |
| 89 | AD-20694-b1 | 0.061 | 0.067 | 0.064 | 0.633 |
| 90 | AD-20700-b1 | 0.124 | 0.106 | 0.115 | 0.890 |
| 91 | AD-20702-b1 | 0.069 | 0.046 | 0.058 | 0.864 |
| 92 | AD-20707-b1 | 0.061 | 0.044 | 0.052 | 0.519 |
| 93 | AD-20708-b1 | 0.217 | 0.182 | 0.199 | 1.529 |
| 94 | AD-20709-b1 | 0.121 | 0.132 | 0.126 | 0.736 |
| 95 | AD-20714-b1 | 0.060 | 0.088 | 0.074 | 1.221 |
| 96 | AD-20716-b1 | 0.074 | 0.074 | 0.074 | 0.697 |
| 97 | AD-20728-b1 | 0.171 | 0.146 | 0.159 | 0.794 |
| 98 | AD-20730-b1 | 0.061 | 0.052 | 0.056 | 0.484 |
| 99 | AD-20741-b1 | 0.065 | 0.056 | 0.061 | 0.367 |
| 100 | AD-20764-b1 | 0.069 | 0.083 | 0.076 | 0.510 |
| 101 | AD-20783-b1 | 0.141 | 0.221 | 0.181 | 0.603 |

Example 5

HeLa Cell Screen of HSF1 RNAi Agents

The 101 duplexes in Table 2 were screened in HeLa cells in a dose response screen. The purpose of this screen was to determine the EC50 (minimum dosage of RNAi agent capable of reducing gene expression by 50%).

A serial dilution was used, comprising 12 concentrations between 10 nM and $1\times10^{-5}$ nM. The siRNA duplexes were transfected into cells using Lipofectamine RNAiMax (Zhao et al. 2008 Mol. Biotech. 40: 19-26). After 24 hours total RNA is isolated and used for cDNA synthesis using random primers. 10-20 ng of total cDNA is used for TaqMan assays (Applied Biosystems, Foster City, Calif.). Each duplex was assayed in duplicate. Data are expressed as the average-fold change compared to the non-targeting control AD-1955, which does not bind to HSF1. AD1955 is a siRNA targeting firefly luciferase and is used as a negative control siRNA in screening assays. The results are shown in Table 6.

TABLE 6

EC50 data*

| Duplex ID | EC50 (nM) | EC50 (nM) | EC50 (nM) | Average EC50 (nM) |
|---|---|---|---|---|
| AD-20303-b1 | 0.06064 | 0.01286 |  | 0.03675 |
| AD-20313-b1 | 0.22911 | 0.07929 |  | 0.15420 |
| AD-20315-b1 | 0.00920 | 0.00358 |  | 0.00639 |
| AD-20348-b1 | 1.12593 | 0.44938 |  | 0.78766 |
| AD-20362-b1 | 0.88761 | 0.83959 |  | 0.86360 |
| AD-20364-b1 | 0.05833 | 0.09057 |  | 0.07445 |
| AD-20365-b1 | 0.01115 | 0.01565 |  | 0.01340 |
| AD-20366-b1 | 0.25818 | 0.27311 |  | 0.26565 |
| AD-20373-b1 | 0.01657 | 0.03293 |  | 0.02475 |
| AD-20376-b1 | 0.00400 | 0.00614 |  | 0.00507 |
| AD-20377-b1 | 0.46977 | 0.75572 |  | 0.61274 |
| AD-20386-b1 | 0.00054 | 0.00045 |  | 0.00049 |
| AD-20389-b1 | 0.08152 | 0.07000 |  | 0.07576 |
| AD-20391-b1 | 0.00569 | 0.00357 |  | 0.00463 |
| AD-20392-b1 | 0.02855 | 0.05939 |  | 0.04397 |
| AD-20397-b1 | 0.17323 | 0.29137 |  | 0.23230 |
| AD-20398-b1 | 0.54902 | 0.41237 |  | 0.48070 |
| AD-20399-b1 | 0.02232 | 0.01281 |  | 0.01757 |
| AD-20401-b1 | 0.08227 | 0.08691 |  | 0.08459 |
| AD-20402-b1 | 0.00902 | 0.00508 |  | 0.00705 |
| AD-20403-b1 | 0.00110 | 0.00246 |  | 0.00178 |
| AD-20404-b1 | 0.00850 | 0.00912 |  | 0.00881 |
| AD-20406-b1 | 0.00842 | 0.00914 |  | 0.00878 |
| AD-20407-b1 | 0.00236 | 0.00130 |  | 0.00183 |
| AD-20408-b1 | 0.00341 | 0.00289 |  | 0.00315 |
| AD-20409-b1 | 0.00396 | 0.00219 |  | 0.00307 |
| AD-20410-b1 | 0.01225 | 0.01775 |  | 0.01500 |
| AD-20411-b1 | 0.00283 | 0.00104 |  | 0.00193 |
| AD-20413-b1 | No EC50 | No EC50 |  |  |
| AD-20422-b1 | 0.00160 | 0.00155 |  | 0.00157 |
| AD-20428-b1 | 1.37427 | 1.57813 |  | 1.47620 |
| AD-20434-b1 | 0.00212 | 0.00456 |  | 0.00334 |
| AD-20435-b1 | 0.00040 | 0.00032 |  | 0.00036 |
| AD-20437-b1 | <1E−05 | <1E−05 |  |  |
| AD-20438-b1 | 0.00006 | 0.00007 |  | 0.00007 |
| AD-20439-b1 | 0.00029 | 0.00010 |  | 0.00020 |
| AD-20487-b1 | <1E−05 | <1E−05 |  |  |
| AD-20488-b1 | 0.00020 | 0.00013 |  | 0.00016 |
| AD-20489-b1 | <1E−05 | <1E−05 |  |  |
| AD-20490-b1 | 0.00026 | 0.00015 |  | 0.00021 |
| AD-20491-b1 | 0.00004 | <1E−05 |  | 0.00004 |
| AD-20493-b1 | 0.00218 | 0.00173 |  | 0.00196 |
| AD-20495-b1 | 0.03348 | 0.00792 | 0.0168299 | 0.01941 |
| AD-20502-b1 | 0.03910 | 0.00037 | 0.0125045 | 0.01732 |
| AD-20507-b1 | >10 | 0.22784 | >10 | 0.22784 |
| AD-20513-b1 | 0.09514 | <1E−05 | 0.0329948 | 0.06407 |
| AD-20527-b1 | 0.08362 | 0.03872 | 0.0415847 | 0.05464 |
| AD-20535-b1 | 0.58303 | 0.00181 | 0.1768769 | 0.25390 |
| AD-20544-b1 | 0.01126 | 0.00062 | 0.1768769 | 0.06292 |
| AD-20545-b1 | 0.01193 | 0.00229 |  | 0.00711 |
| AD-20546-b1 | 0.36163 | 0.04777 |  | 0.20470 |
| AD-20547-b1 | 0.05830 | 0.01273 |  | 0.03551 |
| AD-20548-b1 | 0.00108 | 0.00013 |  | 0.00061 |
| AD-20549-b1 | 0.25058 | 0.02762 |  | 0.13910 |
| AD-20552-b1 | 0.13845 | 0.03697 |  | 0.08771 |
| AD-20555-b1 | 0.02863 | 0.01263 |  | 0.02063 |
| AD-20556-b1 | 0.01001 | 0.00508 | 0.0463849 | 0.02049 |
| AD-20557-b1 | 0.00091 | 0.00073 | 0.0085311 | 0.00339 |
| AD-20558-b1 | 0.07906 | 0.06566 | 0.2598412 | 0.13485 |
| AD-20560-b1 | <1E−05 | <1E−05 | <1E−05 |  |
| AD-20561-b1 | 0.02092 | 0.02674 | 0.0519951 | 0.03322 |
| AD-20562-b1 | 0.00051 | 0.00046 | 0.0022001 | 0.00105 |
| AD-20563-b1 | 0.00004 | 0.00003 | 0.0006466 | 0.00024 |
| AD-20564-b1 | <1E−05 | <1E−05 | <1E−05 |  |
| AD-20565-b1 | 0.01335 | 0.00991 | 0.0159182 | 0.01306 |
| AD-20566-b1 | 0.00296 | 0.00239 | 0.0030765 | 0.00281 |
| AD-20572-b1 | 0.06851 | 0.05459 | 0.2656989 | 0.12960 |
| AD-20574-b1 | 0.86331 | 0.70143 | 2.5513791 | 1.37204 |
| AD-20575-b1 | 0.13577 | 0.13435 | 0.2985167 | 0.18954 |
| AD-20577-b1 | 0.07983 | 0.08513 | 0.1931093 | 0.11936 |
| AD-20578-b1 | 0.00050 | 0.00035 |  | 0.00043 |
| AD-20579-b1 | 0.12105 | 0.08562 |  | 0.10334 |
| AD-20625-b1 | 0.01117 | 0.01037 |  | 0.01077 |
| AD-20626-b1 | 0.00030 | 0.00027 |  | 0.00028 |
| AD-20627-b1 | <1E−05 | <1E−05 |  |  |
| AD-20633-b1 | 0.04183 | 0.04183 |  | 0.04183 |
| AD-20634-b1 | 0.00371 | 0.00450 |  | 0.00410 |
| AD-20640-b1 | 0.00760 | 0.00294 |  | 0.00527 |
| AD-20644-b1 | 0.00098 | 0.00123 |  | 0.00111 |
| AD-20646-b1 | 0.00007 | 0.00008 |  | 0.00008 |
| AD-20648-b1 | 0.00104 | 0.00126 |  | 0.00115 |
| AD-20650-b1 | 0.00059 | 0.05479 |  | 0.02769 |
| AD-20652-b1 | 0.00003 | <1E−05 |  | 0.00003 |
| AD-20653-b1 | 0.00887 | 0.00177 |  | 0.00532 |
| AD-20660-b1 | 0.01515 | 0.00394 |  | 0.00955 |
| AD-20661-b1 | 0.45059 | 0.11322 |  | 0.28191 |
| AD-20671-b1 | 0.02504 | 0.01948 |  | 0.02226 |
| AD-20693-b1 | 0.00080 | 0.00013 |  | 0.00046 |
| AD-20694-b1 | 0.00105 | 0.00123 |  | 0.00114 |
| AD-20700-b1 | 0.04602 | 0.04089 |  | 0.04345 |
| AD-20702-b1 | 0.00015 | 0.00006 |  | 0.00010 |
| AD-20707-b1 | <1E−05 | <1E−05 |  |  |
| AD-20708-b1 | 0.99910 | 0.32099 |  | 0.66004 |
| AD-20709-b1 | 0.01314 | 0.00120 |  | 0.00717 |
| AD-20714-b1 | 0.00599 | 0.01470 |  | 0.01035 |
| AD-20716-b1 | 0.00303 | 0.00103 |  | 0.00203 |
| AD-20728-b1 | 0.26241 | 0.15661 |  | 0.20951 |
| AD-20730-b1 | 0.00331 | 0.00346 |  | 0.00339 |
| AD-20741-b1 | 0.00094 | 0.00033 |  | 0.00064 |
| AD-20764-b1 | 0.01432 | 0.00638 |  | 0.01035 |
| AD-20783-b1 | 0.08658 | 0.05859 |  | 0.07259 |

*wherein "<1E−05" means less than $1 \times 10^{-5}$.

Example 6

Additional Screening of HSF1 RNAi Agents

After making the determinations reported in Tables 4 and 5, it was determined that certain of the oligonucleotides were subject to concentration artifacts now thought to arise from incomplete thawing of plates containing the oligonucleotides. Subsequent analysis of two large datasets (unrelated to Target) indicated that any such concentration artifacts would not alter the assay results more than that which can be accounted for by normal experimental variability. Moreover, these concentration artifacts are unlikely to substantially affect our conclusions about lead selection.

Additional screening data of the HSF1 siRNAs described above is presented in Table 7, below.

HSF1 Rescreen

HSF1 siRNAs are rescreened to address discrepancies that are found in duplex concentrations when the single strands for these duplexes are originally annealed. 414 siRNAs are reannealed and screened at two siRNA concentrations, 10 nM and 0.1 nM. All duplexes are screened at both doses in two independent experiments.

In Vitro Screening

Cell Culture and Transfections

HeLa (ATCC, Manassas, Va.) cells are grown to near confluence at 37° C. in an atmosphere of 5% $CO_2$ in EMEM (ATCC) supplemented with 10% FBS, streptomycin, and glutamine (ATCC) before being released from the plate by trypsinization. Reverse transfection is carried out by adding to 5 µl of 200 nM or 2 nM siRNA duplex per well into a 96-well plate along with 15 µl of Opti-MEM plus 0.2 µl of Lipofectamine RNAiMax per well (Invitrogen, Carlsbad Calif. cat #13778-150) and incubated at room temperature for 15 minutes. 80 µl of complete growth media without antibiotic containing $2 \times 10^4$ Hela cells are then added resulting in a final duplex concentration of 10 nM or 0.1 nM. Cells are incubated for 24 hours prior to RNA purification.

mRNA Isolation Using Dynobeads (Invitrogen, Carlsbad Calif. cat #610-12):

Cells are harvested and lysed in 150 µl of lysis buffer then mixed for 5 minutes at 850 rpm using and platform shaker (the mixing speed is the same throughout the process). Ten micro liters of magnetic beads that had previously been washed in 70 ul of lysis buffer are added into cell-lysate and mixed for 5 minutes. Magnetic beads are captured using magnetic stand and the supernatant is removed without disturbing the beads. Magnetic beads/RNA are washed twice with wash buffer A by adding 150 ul of buffer, shaking for 1 minute and discarding supernatant following capture of beads on magnetic stand. Beads are then washed with 150 µl wash buffer B, agitated for 1 minute, captured a magnetic bead stand and supernatant is removed. The Dynobead/mRNA mixture is then washed with 150 ul of elution buffer by shaking for 1 minute, capturing on a magnetic ring stand and discarding the elution buffer. mRNA is eluted by adding 50 ul of elution buffer and shaking for 4 minutes at 70° C. After mixing plates are placed on the magnetic bead stand for 2 minutes to recapture the beads before the supernatant containing the eluted RNA is removed to a new plate.

cDNA Synthesis Using ABI High Capacity cDNA Reverse Transcription Kit

A master mix of 1 µl 10× Buffer, 0.4 µl 25×dNTPs, 1 µl Random primers, 0.5 µl Reverse Transcriptase, 0.5 µl RNase inhibitor and 1.6 µl of $H_2O$ per reaction are added into 50 total RNA. cDNA is generated using a Bio-Rad C-1000 or S-1000 thermal cycler (Hercules, Calif.) through the following steps: 25° C. 10 min, 37° C. 120 min, 85° C. 5 sec, 4° C. hold.

Real time PCR: 2 µl of cDNA are added to a master mix containing 0.5 ul GAPDH TaqMan Probe (Applied Biosystems Cat #4326317E) or 18S Tag Man Probe (Applied Biosystems Cat #4319413E), 0.50 HSF1 TaqMan probe (Applied Biosystems cat #HS00232134M1) and 5 µl Roche Probes Master Mix (Roche Cat #04887301001) in a total of 10 µl per well in a LightCycler 480 384 well plate (Roche cat #0472974001). Real time PCR is done in a LightCycler 480 Real Time PCR machine (Roche). Each duplex is tested in at two independent transfections (Called Screen 1 and Screen 2). Each transfection is assayed in duplicate. For Screen 1 and Screen 2, qPCR is performed using GAPDH for normalization. For Screen 1, qPCR is repeated a second time using 18S for normalization.

Real time data are analyzed using the ΔΔCt method (Livak et al 2001). Each sample is normalized to GAPDH or 18S expression and knockdown is assessed relative to cells transfected with the non-targeting duplex AD-1955. Higher values represent less knockdown. Reference: Analysis of Relative Gene Expression Data Using Real-Time Quantitative PCR and the 2-ΔΔCT Method. Kenneth J. Livak, Thomas D. Schmittge. Methods 25:4, December 2001, 402-408.

As shown in Table 7, below, certain HSF1 siRNAs are re-screened twice (Screens 1 and 2), using GAPDH and 18S as controls. This table also includes screening data for several HSF1 siRNAs without data presented above. Numbers represent residual HSF1 gene activity, with GAPDH or 18S as control reference genes. Thus, for example, for AD-20278-b2, "0.08" at "10 nM Screen 1 (GAPDH)" indicates 8% residual HSF1 gene activity, or 92% gene knockdown.

TABLE 7

| ADDITIONAL SCREENING OF HSF1 siRNAs (10 nM and 0.1 nM) | | | | | | |
| --- | --- | --- | --- | --- | --- | --- |
| Duplex ID | 10 nM Screen 1 (GAPDH) | 10 nM Screen 1 (18s) | 10 nM Screen 2 (GAPDH) | 0.1 nM Screen 1 (GAPDH) | 0.1 nM Screen 1 (18s) | 0.1 nM Screen 2 (GAPDH) |
| AD-20278-b2 | 0.08 | 0.07 | 0.05 | 0.49 | 0.15 | 0.39 |
| AD-20279-b2 | 0.06 | 0.06 | 0.05 | 0.26 | 0.20 | 0.27 |
| AD-20280-b2 | 0.19 | 0.21 | 0.15 | 0.71 | 0.57 | 0.70 |
| AD-20281-b2 | 0.11 | 0.07 | 0.08 | 0.56 | 0.48 | 0.54 |
| AD-20282-b2 | 0.10 | 0.08 | 0.05 | 1.13 | 0.89 | 1.13 |
| AD-20283-b2 | 0.11 | 0.10 | 0.08 | 1.10 | 1.05 | 1.06 |
| AD-20284-b2 | 0.78 | 0.94 | 0.71 | 1.86 | 0.92 | 1.12 |
| AD-20285-b2 | 0.83 | 1.18 | 1.11 | 1.19 | 0.96 | 1.08 |
| AD-20286-b2 | 1.04 | 1.20 | 0.97 | 1.20 | 0.96 | 1.08 |
| AD-20287-b2 | 1.06 | 1.30 | 1.06 | 1.03 | 1.04 | 1.05 |
| AD-20288-b2 | 0.89 | 0.70 | 0.95 | 0.98 | 1.01 | 1.07 |
| AD-20289-b2 | 1.42 | 1.43 | 1.38 | 1.24 | 1.07 | 1.02 |
| AD-20290-b2 | 1.05 | 0.95 | 1.09 | 1.03 | 0.92 | 1.05 |
| AD-20291-b2 | 0.98 | 0.86 | 0.91 | 1.29 | 0.92 | 1.12 |
| AD-20292-b2 | 1.04 | 0.93 | 1.06 | 1.16 | 1.05 | 1.18 |
| AD-20293-b2 | 0.90 | 0.81 | 0.95 | 1.11 | 0.82 | 1.16 |
| AD-20294-b2 | 0.81 | 0.71 | 0.77 | 1.22 | 0.95 | 1.21 |
| AD-20295-b2 | 0.85 | 0.90 | 0.86 | 0.97 | 0.85 | 1.00 |
| AD-20296-b2 | 0.34 | 0.27 | 0.30 | 1.02 | 0.80 | 1.09 |
| AD-20297-b2 | 0.78 | 0.73 | 0.86 | 0.99 | 0.82 | 1.01 |
| AD-20298-b2 | 1.65 | 0.77 | 0.89 | 1.24 | 1.03 | 1.05 |
| AD-20299-b2 | 0.88 | 0.81 | 0.91 | 1.12 | 0.95 | 1.05 |

TABLE 7-continued

ADDITIONAL SCREENING OF HSF1 siRNAs (10 nM and 0.1 nM)

| Duplex ID | 10 nM Screen 1 (GAPDH) | 10 nM Screen 1 (18s) | 10 nM Screen 2 (GAPDH) | 0.1 nM Screen 1 (GAPDH) | 0.1 nM Screen 1 (18s) | 0.1 nM Screen 2 (GAPDH) |
|---|---|---|---|---|---|---|
| AD-20300-b2 | 0.83 | 0.52 | 0.75 | 1.12 | 0.83 | 1.07 |
| AD-20301-b2 | 0.99 | 0.42 | 0.81 | 0.88 | 0.99 | 0.85 |
| AD-20302-b2 | 0.97 | 1.14 | 1.04 | 0.96 | 0.90 | 1.02 |
| AD-20303-b2 | 0.11 | 0.07 | 0.07 | 0.76 | 0.64 | 0.72 |
| AD-20304-b2 | 0.86 | 0.85 | 0.81 | 1.03 | 0.81 | 1.07 |
| AD-20305-b2 | 1.03 | 1.04 | 1.04 | 1.08 | 0.91 | 1.06 |
| AD-20306-b2 | 0.96 | 0.85 | 0.89 | 1.08 | 0.85 | 0.99 |
| AD-20307-b2 | 1.11 | 1.02 | 1.00 | 1.23 | 0.84 | 1.07 |
| AD-20308-b2 | 1.03 | 1.16 | 1.06 | 1.15 | 0.80 | 1.18 |
| AD-20309-b2 | 1.06 | 0.92 | 1.05 | 1.00 | 0.95 | 1.16 |
| AD-20310-b2 | 1.12 | 0.93 | 1.12 | 0.99 | 0.87 | 1.17 |
| AD-20311-b2 | 1.06 | 0.81 | 0.87 | 1.13 | 0.83 | 1.10 |
| AD-20312-b2 | 0.36 | 0.33 | 0.35 | 0.86 | 0.83 | 0.81 |
| AD-20313-b2 | 0.30 | 0.09 | 0.23 | 0.77 | 1.23 | 0.69 |
| AD-20314-b2 | 0.80 | 0.65 | 0.78 | 1.08 | 0.83 | 1.17 |
| AD-20315-b2 | 0.21 | 0.14 | 0.16 | 0.86 | 0.79 | 0.85 |
| AD-20316-b2 | 0.57 | 0.50 | 0.54 | 1.09 | 0.79 | 1.15 |
| AD-20317-b2 | 0.89 | 0.95 | 0.88 | 1.27 | 1.10 | 1.06 |
| AD-20318-b2 | 0.89 | 0.93 | 0.84 | 1.04 | 1.10 | 1.15 |
| AD-20319-b2 | 0.87 | 0.63 | 0.97 | 1.13 | 1.06 | 1.22 |
| AD-20320-b2 | 0.85 | 0.56 | 0.81 | 1.05 | 0.96 | 1.19 |
| AD-20344-b2 | 0.67 | 0.54 | 0.50 | 1.05 | 1.05 | 1.03 |
| AD-20345-b2 | 0.77 | 0.35 | 0.76 | 1.01 | 1.03 | 1.07 |
| AD-20346-b2 | 1.13 | 0.96 | 0.86 | 1.17 | 1.08 | 1.04 |
| AD-20347-b2 | 0.78 | 0.94 | 0.75 | 0.95 | 0.91 | 1.07 |
| AD-20348-b2 | 0.90 | 0.19 | 0.74 | 0.77 | 0.63 | 0.80 |
| AD-20349-b2 | 0.57 | 0.47 | 0.57 | 0.92 | 0.73 | 0.82 |
| AD-20350-b2 | 0.85 | 0.72 | 0.88 | 1.11 | 0.72 | 0.92 |
| AD-20351-b2 | 1.04 | 0.84 | 1.12 | 1.16 | 1.09 | 1.08 |
| AD-20352-b2 | 1.12 | 0.88 | 0.93 | 0.99 | 1.13 | 1.27 |
| AD-20353-b2 | 0.77 | 0.53 | 0.62 | 1.01 | 0.81 | 1.10 |
| AD-20354-b2 | 0.78 | 0.49 | 0.77 | 0.99 | 0.85 | 1.10 |
| AD-20355-b2 | 1.13 | 0.53 | 0.85 | 0.97 | 0.91 | 1.06 |
| AD-20356-b2 | 0.72 | 0.63 | 0.77 | 0.95 | 0.81 | 1.05 |
| AD-20357-b2 | 1.31 | 0.98 | 0.97 | 0.96 | 0.89 | 1.25 |
| AD-20358-b2 | 1.09 | 0.76 | 1.03 | 0.92 | 0.81 | 1.16 |
| AD-20359-b2 | 1.08 | 1.06 | 1.17 | 1.23 | 0.95 | 1.03 |
| AD-20360-b2 | 1.04 | 1.10 | 1.04 | 1.28 | 1.00 | 0.90 |
| AD-20361-b2 | 0.93 | 0.84 | 0.95 | 1.03 | 0.88 | 1.04 |
| AD-20362-b2 | 0.40 | 0.21 | 0.33 | 1.23 | 0.64 | 1.05 |
| AD-20363-b2 | 1.16 | 0.79 | 0.98 | 1.05 | 0.63 | 1.25 |
| AD-20364-b2 | 0.40 | 0.21 | 0.25 | 0.96 | 0.42 | 0.91 |
| AD-20365-b2 | 0.22 | 0.12 | 0.17 | 0.62 | 0.57 | 0.50 |
| AD-20366-b2 | 0.46 | 0.20 | 0.31 | 0.95 | 0.93 | 0.84 |
| AD-20367-b2 | 1.00 | 0.59 | 0.83 | 1.00 | 0.71 | 0.99 |
| AD-20368-b2 | 1.20 | 0.50 | 1.12 | 1.15 | 0.87 | 0.97 |
| AD-20369-b2 | 1.02 | 0.82 | 0.90 | 0.88 | 0.88 | 0.85 |
| AD-20370-b2 | 1.04 | 0.78 | 0.83 | 1.03 | 0.88 | 0.96 |
| AD-20371-b2 | 1.19 | 0.71 | 1.09 | 1.08 | 0.83 | 0.98 |
| AD-20372-b2 | 1.15 | 0.73 | 0.97 | 1.07 | 0.97 | 0.85 |
| AD-20373-b2 | 0.20 | 0.15 | 0.16 | 0.74 | 0.54 | 0.78 |
| AD-20374-b2 | 0.70 | 0.43 | 0.58 | 1.10 | 0.67 | 1.04 |
| AD-20375-b2 | 0.85 | 0.65 | 0.72 | 1.21 | 0.81 | 1.06 |
| AD-20376-b2 | 0.13 | 0.07 | 0.09 | 0.48 | 0.25 | 0.37 |
| AD-20377-b2 | 0.35 | 0.19 | 0.21 | 0.88 | 0.71 | 0.78 |
| AD-20378-b2 | 1.17 | 0.94 | 1.19 | 1.03 | 0.84 | 0.98 |
| AD-20379-b2 | 0.68 | 0.43 | 0.60 | 0.98 | 0.77 | 0.95 |
| AD-20380-b2 | 0.64 | 0.43 | 0.67 | 1.01 | 0.81 | 0.97 |
| AD-20381-b2 | 1.40 | 1.15 | 1.49 | 1.19 | 0.89 | 1.13 |
| AD-20382-b2 | 1.06 | 0.73 | 0.97 | 1.00 | 0.94 | 0.91 |
| AD-20383-b2 | 1.00 | 0.95 | 1.02 | 1.02 | 0.94 | 1.00 |
| AD-20384-b2 | 1.05 | 0.81 | 0.86 | 0.99 | 1.07 | 0.91 |
| AD-20385-b2 | 1.15 | 0.79 | 0.97 | 1.19 | 0.78 | 1.10 |
| AD-20386-b2 | 0.17 | 0.04 | 0.12 | 0.37 | 0.32 | 0.31 |
| AD-20387-b2 | 0.69 | 0.38 | 0.45 | 1.06 | 0.81 | 0.93 |
| AD-20388-b2 | 0.66 | 0.59 | 0.45 | 0.98 | 0.80 | 0.89 |
| AD-20389-b2 | 0.11 | 0.07 | 0.08 | 0.76 | 0.56 | 0.67 |
| AD-20390-b2 | 0.47 | 0.46 | 0.41 | 1.11 | 0.96 | 1.12 |
| AD-20391-b2 | 0.07 | 0.07 | 0.05 | 0.53 | 0.41 | 0.42 |
| AD-20392-b2 | 0.15 | 0.06 | 0.05 | 0.74 | 0.59 | 0.72 |
| AD-20393-b2 | 0.75 | 0.45 | 0.73 | 1.11 | 0.86 | 0.96 |
| AD-20394-b2 | 1.20 | 0.93 | 1.02 | 1.25 | 0.91 | 0.99 |
| AD-20395-b2 | 0.65 | 0.38 | 0.60 | 1.35 | 0.92 | 0.99 |
| AD-20396-b2 | 0.78 | 0.57 | 0.65 | 1.09 | 0.90 | 1.03 |

TABLE 7-continued

ADDITIONAL SCREENING OF HSF1 siRNAs (10 nM and 0.1 nM)

| Duplex ID | 10 nM Screen 1 (GAPDH) | 10 nM Screen 1 (18s) | 10 nM Screen 2 (GAPDH) | 0.1 nM Screen 1 (GAPDH) | 0.1 nM Screen 1 (18s) | 0.1 nM Screen 2 (GAPDH) |
|---|---|---|---|---|---|---|
| AD-20397-b2 | 0.26 | 0.22 | 0.21 | 0.98 | 0.92 | 0.92 |
| AD-20398-b2 | 0.60 | 0.39 | 0.61 | 1.08 | 1.04 | 1.03 |
| AD-20399-b2 | 0.12 | 0.07 | 0.08 | 0.71 | 0.72 | 0.73 |
| AD-20400-b2 | 0.52 | 0.46 | 0.48 | 1.08 | 1.12 | 1.03 |
| AD-20401-b2 | 0.16 | 0.07 | 0.06 | 0.71 | 0.82 | 0.70 |
| AD-20402-b2 | 0.06 | 0.05 | 0.04 | 0.45 | 0.37 | 0.38 |
| AD-20403-b2 | 0.09 | 0.05 | 0.04 | 0.62 | 0.45 | 0.63 |
| AD-20404-b2 | 0.14 | 0.06 | 0.06 | 0.69 | 0.51 | 0.67 |
| AD-20405-b2 | 1.26 | 0.87 | 1.01 | 1.18 | 0.93 | 1.10 |
| AD-20406-b2 | 0.32 | 0.11 | 0.21 | 0.82 | 0.57 | 0.82 |
| AD-20407-b2 | 0.16 | 0.06 | 0.07 | 0.66 | 0.50 | 0.67 |
| AD-20408-b2 | 0.15 | 0.06 | 0.06 | 0.73 | 0.57 | 0.66 |
| AD-20409-b2 | 0.20 | 0.09 | 0.11 | 0.67 | 0.55 | 0.62 |
| AD-20410-b2 | 0.19 | 0.08 | 0.09 | 0.70 | 0.66 | 0.62 |
| AD-20411-b2 | 0.12 | 0.09 | 0.09 | 0.58 | 0.54 | 0.58 |
| AD-20412-b2 | 0.84 | 0.80 | 0.83 | 1.12 | 0.92 | 0.94 |
| AD-20413-b2 | 0.16 | 0.14 | 0.18 | 0.71 | 0.71 | 0.69 |
| AD-20414-b2 | 0.74 | 0.91 | 0.72 | 1.05 | 1.08 | 0.98 |
| AD-20415-b2 | 0.64 | 0.80 | 0.66 | 0.87 | 1.62 | 0.84 |
| AD-20416-b2 | 1.30 | 0.74 | 1.22 | 1.24 | 0.90 | 1.09 |
| AD-20417-b2 | 1.27 | 0.75 | 0.93 | 1.12 | 0.87 | 1.04 |
| AD-20418-b2 | 1.25 | 0.68 | 1.14 | 1.12 | 0.83 | 0.99 |
| AD-20419-b2 | 1.19 | 0.76 | 1.07 | 1.17 | 0.92 | 0.91 |
| AD-20420-b2 | 0.95 | 0.81 | 0.89 | 1.19 | 0.93 | 1.04 |
| AD-20421-b2 | 0.80 | 0.32 | 0.67 | 1.29 | 0.84 | 0.97 |
| AD-20422-b2 | 0.20 | 0.04 | 0.08 | 0.41 | 0.32 | 0.37 |
| AD-20423-b2 | 1.23 | 0.79 | 1.11 | 1.06 | 0.99 | 1.03 |
| AD-20424-b2 | 0.87 | 0.60 | 0.78 | 0.96 | 0.95 | 0.98 |
| AD-20425-b2 | 1.02 | 0.75 | 1.13 | 0.98 | 1.08 | 0.98 |
| AD-20426-b2 | 0.53 | 0.30 | 0.31 | 0.94 | 0.93 | 0.99 |
| AD-20427-b2 | 0.47 | 0.45 | 0.47 | 0.93 | 1.12 | 0.91 |
| AD-20428-b2 | 0.29 | 0.23 | 0.28 | 1.04 | 0.76 | 0.96 |
| AD-20429-b2 | 1.10 | 0.50 | 1.15 | 1.12 | 0.85 | 0.96 |
| AD-20430-b2 | 1.00 | 0.77 | 0.88 | 1.14 | 0.78 | 1.03 |
| AD-20431-b2 | 1.17 | 0.59 | 1.06 | 1.13 | 0.85 | 0.95 |
| AD-20432-b2 | 1.04 | 0.55 | 1.09 | 1.11 | 0.82 | 0.94 |
| AD-20433-b2 | 0.82 | 0.28 | 0.74 | 1.20 | 1.05 | 1.00 |
| AD-20434-b2 | 0.19 | 0.08 | 0.09 | 0.60 | 0.54 | 0.51 |
| AD-20435-b2 | 0.41 | 0.04 | 0.33 | 0.37 | 0.26 | 0.27 |
| AD-20436-b2 | 0.40 | 0.22 | 0.35 | 1.13 | 1.12 | 1.11 |
| AD-20437-b2 | 0.08 | 0.04 | 0.03 | 0.16 | 0.16 | 0.12 |
| AD-20438-b2 | 0.06 | 0.04 | 0.03 | 0.35 | 0.20 | 0.22 |
| AD-20439-b2 | 0.09 | 0.07 | 0.07 | 0.47 | 0.30 | 0.39 |
| AD-20487-b2 | 0.10 | 0.03 | 0.06 | 0.15 | 0.11 | 0.10 |
| AD-20488-b2 | 0.13 | 0.03 | 0.08 | 0.44 | 0.30 | 0.34 |
| AD-20489-b2 | 0.09 | 0.03 | 0.05 | 0.21 | 0.16 | 0.18 |
| AD-20490-b2 | 0.13 | 0.03 | 0.08 | 0.46 | 0.26 | 0.41 |
| AD-20491-b2 | 0.26 | 0.03 | 0.16 | 0.33 | 0.22 | 0.20 |
| AD-20492-b2 | 1.12 | 0.62 | 1.11 | 1.07 | 0.78 | 0.93 |
| AD-20493-b2 | 0.18 | 0.04 | 0.10 | 0.51 | 0.35 | 0.40 |
| AD-20494-b2 | 0.54 | 0.31 | 0.42 | 1.26 | 0.79 | 0.96 |
| AD-20495-b2 | 0.26 | 0.28 | 0.15 | 0.77 | 0.68 | 0.71 |
| AD-20496-b2 | 0.97 | 0.69 | 0.87 | 1.08 | 1.09 | 1.24 |
| AD-20497-b2 | 1.21 | 0.86 | 1.19 | 1.31 | 0.86 | 0.98 |
| AD-20498-b2 | 1.14 | 0.82 | 0.81 | 1.28 | 0.84 | 1.07 |
| AD-20499-b2 | 1.25 | 0.80 | 0.91 | 1.13 | 0.71 | 0.95 |
| AD-20500-b2 | 0.96 | 0.57 | 0.98 | 1.26 | 0.79 | 0.97 |
| AD-20501-b2 | 0.69 | 0.37 | 0.47 | 0.89 | 0.68 | 0.84 |
| AD-20502-b2 | 0.28 | 0.12 | 0.16 | 0.88 | 0.54 | 0.88 |
| AD-20503-b2 | 1.12 | 0.76 | 1.04 | 1.10 | 0.96 | 1.10 |
| AD-20504-b2 | 1.00 | 0.52 | 0.89 | 1.09 | 0.95 | 0.98 |
| AD-20505-b2 | 1.11 | 0.64 | 0.92 | 1.22 | 1.03 | 1.20 |
| AD-20506-b2 | 0.86 | 0.40 | 0.78 | 1.25 | 1.14 | 1.01 |
| AD-20507-b2 | 0.11 | 0.04 | 0.09 | 0.34 | 0.27 | 0.32 |
| AD-20508-b2 | 1.07 | 0.67 | 1.14 | 1.16 | 0.96 | 1.09 |
| AD-20509-b2 | 1.03 | 0.79 | 0.90 | 1.25 | 1.04 | 0.99 |
| AD-20510-b2 | 0.37 | 0.27 | 0.31 | 1.35 | 1.21 | 1.33 |
| AD-20511-b2 | 0.54 | 0.39 | 0.44 | 1.13 | 1.02 | 1.05 |
| AD-20512-b2 | 0.66 | 0.42 | 0.55 | 0.98 | 0.99 | 1.09 |
| AD-20513-b2 | 0.20 | 0.09 | 0.12 | 1.06 | 0.93 | 1.05 |
| AD-20514-b2 | 1.26 | 0.83 | 1.15 | 0.97 | 1.00 | 0.98 |
| AD-20515-b2 | 1.02 | 0.64 | 1.13 | 1.13 | 1.01 | 1.01 |
| AD-20516-b2 | 1.11 | 0.45 | 0.94 | 1.09 | 0.94 | 1.11 |
| AD-20517-b2 | 0.92 | 0.64 | 0.83 | 1.03 | 0.97 | 0.95 |

TABLE 7-continued

ADDITIONAL SCREENING OF HSF1 siRNAs (10 nM and 0.1 nM)

| Duplex ID | 10 nM Screen 1 (GAPDH) | 10 nM Screen 1 (18s) | 10 nM Screen 2 (GAPDH) | 0.1 nM Screen 1 (GAPDH) | 0.1 nM Screen 1 (18s) | 0.1 nM Screen 2 (GAPDH) |
|---|---|---|---|---|---|---|
| AD-20518-b2 | 1.08 | 0.66 | 1.08 | 1.15 | 0.96 | 0.96 |
| AD-20519-b2 | 1.27 | 0.80 | 0.94 | 1.11 | 0.94 | 0.99 |
| AD-20520-b2 | 1.06 | 0.83 | 1.06 | 1.17 | 0.84 | 0.98 |
| AD-20521-b2 | 1.28 | 0.82 | 1.14 | 1.02 | 1.08 | 1.00 |
| AD-20522-b2 | 1.11 | 0.94 | 0.93 | 1.12 | 1.04 | 1.05 |
| AD-20523-b2 | 0.92 | 0.95 | 1.11 | 1.19 | 0.86 | 1.21 |
| AD-20524-b2 | 1.13 | 1.04 | 1.03 | 1.09 | 0.89 | 1.16 |
| AD-20525-b2 | 1.06 | 0.97 | 1.18 | 1.27 | 0.96 | 1.18 |
| AD-20526-b2 | 1.08 | 0.83 | 0.94 | 1.11 | 0.93 | 1.11 |
| AD-20527-b2 | 0.47 | 0.19 | 0.42 | 0.70 | 0.68 | 0.63 |
| AD-20528-b2 | 1.22 | 0.74 | 1.09 | 1.41 | 0.83 | 1.00 |
| AD-20529-b2 | 1.09 | 0.98 | 0.99 | 1.16 | 0.85 | 1.01 |
| AD-20530-b2 | 0.67 | 0.23 | 0.50 | 1.03 | 0.99 | 1.08 |
| AD-20531-b2 | 0.43 | 0.41 | 0.47 | 0.92 | 0.92 | 1.02 |
| AD-20532-b2 | 1.16 | 1.01 | 0.98 | 1.12 | 0.86 | 1.05 |
| AD-20533-b2 | 0.86 | 0.97 | 0.83 | 1.14 | 1.05 | 1.12 |
| AD-20534-b2 | 0.52 | 0.61 | 0.56 | 1.04 | 0.97 | 1.03 |
| AD-20535-b2 | 0.47 | 0.18 | 0.32 | 1.01 | 0.79 | 0.96 |
| AD-20536-b2 | 1.43 | 1.06 | 0.82 | 1.11 | 0.89 | 1.19 |
| AD-20537-b2 | 1.24 | 1.11 | 0.93 | 1.02 | 0.86 | 1.17 |
| AD-20538-b2 | 0.92 | 0.66 | 0.90 | 0.96 | 0.75 | 0.96 |
| AD-20539-b2 | 1.12 | 1.06 | 1.02 | 1.14 | 0.86 | 1.02 |
| AD-20540-b2 | 0.97 | 1.19 | 1.06 | 1.04 | 0.94 | 1.02 |
| AD-20541-b2 | 1.06 | 1.22 | 0.91 | 1.27 | 0.84 | 1.07 |
| AD-20542-b2 | 0.97 | 0.77 | 0.85 | 1.08 | 0.88 | 1.03 |
| AD-20543-b2 | 0.69 | 0.88 | 0.63 | 1.12 | 0.89 | 1.07 |
| AD-20544-b2 | 0.15 | 0.11 | 0.11 | 0.64 | 0.63 | 0.64 |
| AD-20545-b2 | 0.11 | 0.08 | 0.08 | 0.69 | 0.65 | 0.65 |
| AD-20546-b2 | 0.17 | 0.21 | 0.14 | 0.98 | 0.85 | 0.94 |
| AD-20547-b2 | 0.36 | 0.21 | 0.22 | 0.90 | 0.66 | 0.80 |
| AD-20548-b2 | 0.12 | 0.04 | 0.18 | 0.39 | 0.32 | 0.32 |
| AD-20549-b2 | 0.44 | 0.20 | 0.33 | 0.90 | 0.93 | 0.91 |
| AD-20550-b2 | 0.65 | 0.43 | 0.53 | 0.87 | 0.64 | 0.78 |
| AD-20551-b2 | 1.23 | 1.09 | 1.12 | 1.20 | 0.91 | 1.02 |
| AD-20552-b2 | 0.29 | 0.19 | 0.20 | 0.97 | 0.71 | 0.84 |
| AD-20553-b2 | 0.96 | 0.89 | 0.87 | 1.14 | 0.96 | 1.12 |
| AD-20554-b2 | 0.57 | 0.55 | 0.57 | 1.18 | 0.82 | 0.90 |
| AD-20555-b2 | 0.26 | 0.14 | 0.17 | 1.00 | 0.92 | 0.97 |
| AD-20556-b2 | 0.15 | 0.12 | 0.10 | 0.98 | 0.77 | 0.87 |
| AD-20557-b2 | 0.09 | 0.08 | 0.05 | 0.74 | 0.59 | 0.71 |
| AD-20558-b2 | 0.10 | 0.12 | 0.08 | 0.91 | 0.89 | 0.93 |
| AD-20559-b2 | 0.58 | 0.41 | 0.42 | 1.13 | 1.01 | 1.09 |
| AD-20560-b2 | 0.09 | 0.03 | 0.03 | 0.25 | 0.18 | 0.23 |
| AD-20561-b2 | 0.31 | 0.09 | 0.26 | 0.93 | 0.86 | 0.92 |
| AD-20562-b2 | 0.21 | 0.04 | 0.12 | 0.55 | 0.42 | 0.56 |
| AD-20563-b2 | 0.15 | 0.04 | 0.17 | 0.50 | 0.38 | 0.46 |
| AD-20564-b2 | 0.06 | 0.03 | 0.03 | 0.15 | 0.11 | 0.15 |
| AD-20565-b2 | 0.17 | 0.09 | 0.09 | 0.79 | 0.55 | 0.69 |
| AD-20566-b2 | 0.07 | 0.04 | 0.03 | 0.55 | 0.34 | 0.47 |
| AD-20567-b2 | 0.78 | 0.84 | 0.71 | 1.27 | 0.92 | 1.01 |
| AD-20568-b2 | 1.07 | 1.21 | 1.03 | 1.49 | 0.90 | 0.98 |
| AD-20569-b2 | 0.87 | 1.21 | 0.90 | 0.94 | 0.97 | 0.98 |
| AD-20570-b2 | 0.35 | 0.37 | 0.29 | 1.13 | 0.94 | 1.03 |
| AD-20571-b2 | 0.99 | 1.08 | 0.91 | 1.03 | 0.88 | 1.02 |
| AD-20572-b2 | 0.52 | 0.09 | 0.34 | 1.06 | 0.88 | 1.02 |
| AD-20573-b2 | 1.28 | 0.79 | 1.22 | 1.11 | 1.01 | 1.15 |
| AD-20574-b2 | 0.34 | 0.29 | 0.22 | 1.00 | 0.95 | 1.06 |
| AD-20575-b2 | 0.32 | 0.23 | 0.21 | 0.96 | 0.95 | 1.01 |
| AD-20576-b2 | 0.52 | 0.44 | 0.49 | 0.94 | 0.91 | 0.98 |
| AD-20577-b2 | 0.59 | 0.36 | 0.55 | 0.95 | 0.70 | 0.90 |
| AD-20578-b2 | 0.08 | 0.06 | 0.06 | 0.27 | 0.20 | 0.24 |
| AD-20579-b2 | 0.35 | 0.15 | 0.23 | 1.17 | 1.05 | 1.12 |
| AD-20580-b2 | 0.31 | 0.37 | 0.25 | 1.21 | 0.93 | 1.07 |
| AD-20581-b2 | 0.65 | 1.21 | 0.75 | 1.08 | 0.85 | 0.97 |
| AD-20582-b2 | 0.30 | 0.53 | 0.36 | 1.00 | 1.02 | 1.10 |
| AD-20594-b2 | 1.17 | 0.92 | 1.11 | 1.08 | 0.86 | 1.04 |
| AD-20595-b2 | 1.23 | 0.89 | 1.37 | 1.17 | 0.84 | 1.01 |
| AD-20596-b2 | 1.11 | 0.94 | 1.11 | 1.13 | 0.81 | 1.15 |
| AD-20597-b2 | 1.03 | 1.14 | 1.07 | 0.59 | 0.99 | 0.52 |
| AD-20598-b2 | 1.05 | 0.93 | 1.07 | 1.27 | 0.89 | 1.23 |
| AD-20625-b2 | 0.23 | 0.13 | 0.23 | 0.73 | 0.70 | 0.71 |
| AD-20626-b2 | 0.21 | 0.21 | 0.24 | 0.43 | 0.41 | 0.39 |
| AD-20627-b2 | 0.22 | 0.07 | 0.21 | 0.62 | 0.48 | 0.60 |
| AD-20628-b2 | 1.14 | 0.38 | 0.97 | 1.23 | 1.08 | 1.06 |

TABLE 7-continued

ADDITIONAL SCREENING OF HSF1 siRNAs (10 nM and 0.1 nM)

| Duplex ID | 10 nM Screen 1 (GAPDH) | 10 nM Screen 1 (18s) | 10 nM Screen 2 (GAPDH) | 0.1 nM Screen 1 (GAPDH) | 0.1 nM Screen 1 (18s) | 0.1 nM Screen 2 (GAPDH) |
|---|---|---|---|---|---|---|
| AD-20629-b2 | 0.62 | 0.29 | 0.53 | 0.96 | 0.90 | 1.02 |
| AD-20630-b2 | 0.50 | 0.25 | 0.40 | 1.16 | 0.98 | 0.94 |
| AD-20631-b2 | 0.78 | 0.30 | 0.58 | 1.04 | 1.07 | 0.93 |
| AD-20632-b2 | 0.76 | 0.90 | 0.70 | 1.06 | 0.97 | 0.97 |
| AD-20633-b2 | 0.28 | 0.23 | 0.17 | 0.97 | 0.98 | 0.94 |
| AD-20634-b2 | 0.21 | 0.16 | 0.19 | 0.74 | 0.86 | 0.74 |
| AD-20635-b2 | 0.48 | 0.41 | 0.50 | 0.88 | 1.07 | 0.88 |
| AD-20636-b2 | 1.37 | 0.99 | 1.01 | 1.10 | 1.19 | 1.00 |
| AD-20637-b2 | 1.05 | 0.66 | 1.05 | 1.09 | 0.94 | 1.11 |
| AD-20638-b2 | 0.82 | 0.39 | 0.72 | 0.97 | 0.94 | 0.95 |
| AD-20639-b2 | 0.60 | 0.39 | 0.57 | 0.82 | 0.81 | 0.80 |
| AD-20640-b2 | 0.20 | 0.08 | 0.19 | 0.77 | 0.78 | 0.76 |
| AD-20641-b2 | 0.93 | 0.66 | 1.10 | 0.96 | 1.00 | 0.96 |
| AD-20642-b2 | 1.17 | 0.49 | 1.02 | 0.95 | 0.95 | 0.99 |
| AD-20643-b2 | 0.48 | 0.23 | 0.45 | 1.04 | 0.92 | 0.97 |
| AD-20644-b2 | 0.32 | 0.16 | 0.31 | 0.82 | 0.71 | 0.78 |
| AD-20645-b2 | 1.26 | 0.83 | 1.13 | 1.00 | 1.09 | 0.96 |
| AD-20646-b2 | 0.21 | 0.17 | 0.22 | 0.44 | 0.57 | 0.42 |
| AD-20647-b2 | 0.52 | 0.17 | 0.42 | 0.80 | 0.74 | 0.75 |
| AD-20648-b2 | 0.16 | 0.19 | 0.08 | 0.65 | 0.68 | 0.64 |
| AD-20649-b2 | 1.11 | 0.74 | 1.08 | 1.16 | 1.00 | 1.17 |
| AD-20650-b2 | 0.90 | 0.39 | 0.88 | 1.15 | 0.97 | 1.02 |
| AD-20651-b2 | 1.28 | 0.75 | 1.22 | 1.06 | 1.03 | 0.96 |
| AD-20652-b2 | 0.15 | 0.06 | 0.17 | 0.33 | 0.31 | 0.34 |
| AD-20653-b2 | 0.48 | 0.17 | 0.43 | 1.14 | 0.97 | 1.00 |
| AD-20654-b2 | 1.33 | 0.90 | 1.19 | 1.12 | 1.08 | 1.06 |
| AD-20655-b2 | 1.20 | 1.13 | 1.14 | 1.20 | 1.07 | 1.04 |
| AD-20656-b2 | 0.96 | 0.63 | 0.92 | 1.18 | 1.09 | 0.98 |
| AD-20657-b2 | 1.13 | 0.75 | 1.28 | 1.00 | 1.09 | 0.94 |
| AD-20658-b2 | 0.62 | 0.40 | 0.52 | 0.67 | 0.67 | 0.65 |
| AD-20659-b2 | 0.98 | 0.74 | 0.82 | 1.05 | 1.01 | 0.94 |
| AD-20660-b2 | 0.24 | 0.16 | 0.12 | 0.83 | 0.85 | 0.83 |
| AD-20661-b2 | 0.44 | 0.19 | 0.41 | 0.95 | 0.93 | 0.93 |
| AD-20662-b2 | 0.95 | 0.42 | 0.84 | 0.83 | 0.90 | 0.85 |
| AD-20663-b2 | 1.35 | 1.11 | 1.29 | 0.96 | 1.20 | 1.02 |
| AD-20664-b2 | 1.15 | 1.24 | 0.92 | 0.97 | 0.94 | 0.98 |
| AD-20665-b2 | 1.23 | 1.06 | 1.03 | 1.02 | 1.02 | 1.09 |
| AD-20666-b2 | 1.29 | 1.09 | 0.94 | 0.97 | 1.07 | 1.11 |
| AD-20667-b2 | 1.24 | 1.04 | 1.28 | 1.02 | 0.96 | 1.05 |
| AD-20668-b2 | 1.19 | 0.99 | 1.22 | 0.98 | 1.04 | 0.99 |
| AD-20669-b2 | 1.49 | 1.13 | 1.19 | 0.95 | 1.08 | 0.94 |
| AD-20670-b2 | 0.90 | 0.68 | 0.92 | 0.83 | 1.07 | 0.82 |
| AD-20671-b2 | 0.19 | 0.11 | 0.12 | 0.72 | 0.72 | 0.73 |
| AD-20672-b2 | 0.67 | 0.56 | 0.54 | 0.92 | 1.11 | 0.92 |
| AD-20673-b2 | 0.97 | 0.72 | 0.84 | 1.20 | 0.92 | 1.04 |
| AD-20674-b2 | 0.58 | 0.66 | 0.63 | 1.16 | 0.93 | 1.10 |
| AD-20675-b2 | 1.48 | 0.90 | 0.92 | 1.08 | 0.98 | 1.07 |
| AD-20676-b2 | 0.80 | 0.44 | 0.80 | 0.94 | 0.99 | 0.95 |
| AD-20677-b2 | 1.31 | 0.96 | 1.13 | 1.24 | 0.93 | 1.03 |
| AD-20678-b2 | 1.00 | 0.44 | 1.11 | 1.18 | 0.99 | 1.15 |
| AD-20679-b2 | 1.14 | 1.15 | 1.04 | 1.20 | 1.04 | 1.03 |
| AD-20680-b2 | 1.06 | 0.85 | 0.81 | 1.11 | 1.07 | 0.99 |
| AD-20681-b2 | 1.37 | 0.93 | 0.99 | 1.10 | 1.11 | 1.03 |
| AD-20682-b2 | 1.17 | 0.80 | 1.04 | 0.96 | 1.09 | 1.06 |
| AD-20683-b2 | 1.37 | 0.63 | 0.95 | 0.51 | 0.51 | 0.50 |
| AD-20684-b2 | 1.19 | 0.66 | 1.00 | 1.07 | 1.19 | 1.00 |
| AD-20685-b2 | 1.18 | 0.81 | 0.97 | 1.19 | 0.90 | 1.02 |
| AD-20686-b2 | 1.22 | 0.72 | 1.09 | 1.27 | 0.98 | 0.90 |
| AD-20687-b2 | 1.33 | 0.71 | 1.02 | 1.11 | 0.94 | 0.94 |
| AD-20688-b2 | 1.37 | 0.77 | 1.15 | 1.04 | 0.99 | 1.10 |
| AD-20689-b2 | 1.05 | 1.00 | 1.21 | 1.12 | 0.98 | 0.92 |
| AD-20690-b2 | 0.95 | 1.11 | 0.81 | 1.18 | 0.95 | 0.99 |
| AD-20691-b2 | 1.44 | 0.85 | 1.11 | 1.14 | 1.01 | 0.93 |
| AD-20692-b2 | 1.22 | 1.85 | 1.31 | 1.02 | 1.05 | 1.46 |
| AD-20693-b2 | 1.27 | 0.32 | 1.08 | 1.06 | 1.01 | 1.05 |
| AD-20694-b2 | 0.46 | 0.12 | 0.42 | 0.68 | 0.45 | 0.70 |
| AD-20695-b2 | 0.41 | 0.14 | 0.36 | 0.74 | 0.75 | 0.73 |
| AD-20696-b2 | 0.84 | 1.09 | 0.82 | 1.08 | 1.06 | 1.11 |
| AD-20697-b2 | 1.34 | 0.67 | 1.15 | 1.25 | 1.02 | 1.02 |
| AD-20698-b2 | 1.25 | 0.74 | 0.99 | 1.11 | 0.92 | 1.09 |
| AD-20699-b2 | 0.97 | 0.50 | 1.08 | 1.16 | 0.91 | 1.04 |
| AD-20700-b2 | 0.45 | 0.21 | 0.24 | 1.10 | 0.81 | 0.91 |
| AD-20701-b2 | 0.87 | 0.30 | 0.82 | 1.14 | 1.01 | 1.06 |
| AD-20702-b2 | 0.36 | 0.08 | 0.26 | 0.53 | 0.42 | 0.54 |

TABLE 7-continued

ADDITIONAL SCREENING OF HSF1 siRNAs (10 nM and 0.1 nM)

| Duplex ID | 10 nM Screen 1 (GAPDH) | 10 nM Screen 1 (18s) | 10 nM Screen 2 (GAPDH) | 0.1 nM Screen 1 (GAPDH) | 0.1 nM Screen 1 (18s) | 0.1 nM Screen 2 (GAPDH) |
|---|---|---|---|---|---|---|
| AD-20703-b2 | 1.02 | 0.44 | 0.92 | 1.17 | 0.92 | 1.01 |
| AD-20704-b2 | 1.38 | 0.82 | 1.14 | 1.09 | 1.02 | 1.11 |
| AD-20705-b2 | 0.78 | 0.35 | 0.65 | 1.05 | 0.99 | 1.10 |
| AD-20706-b2 | 0.70 | 0.33 | 0.64 | 0.87 | 0.83 | 0.80 |
| AD-20707-b2 | 0.13 | 0.07 | 0.14 | 0.54 | 0.43 | 0.55 |
| AD-20708-b2 | 0.30 | 0.12 | 0.22 | 1.08 | 1.08 | 1.08 |
| AD-20709-b2 | 0.38 | 0.19 | 0.25 | 0.90 | 0.92 | 0.91 |
| AD-20710-b2 | 1.00 | 0.47 | 1.07 | 1.15 | 1.01 | 1.12 |
| AD-20711-b2 | 0.71 | 0.44 | 0.68 | 1.16 | 0.99 | 1.13 |
| AD-20712-b2 | 1.01 | 0.71 | 1.06 | 0.67 | 0.47 | 0.62 |
| AD-20713-b2 | 0.61 | 0.22 | 0.44 | 1.17 | 0.79 | 0.92 |
| AD-20714-b2 | 0.49 | 0.07 | 0.39 | 0.56 | 0.71 | 0.68 |
| AD-20715-b2 | 0.37 | 0.08 | 0.19 | 1.12 | 0.94 | 1.00 |
| AD-20716-b2 | 0.20 | 0.07 | 0.12 | 0.87 | 0.58 | 0.74 |
| AD-20717-b2 | 0.81 | 0.62 | 0.71 | 1.18 | 0.86 | 0.92 |
| AD-20718-b2 | 0.30 | 0.16 | 0.19 | 1.21 | 0.65 | 0.75 |
| AD-20719-b2 | 0.57 | 0.53 | 0.58 | 0.90 | 0.91 | 0.91 |
| AD-20720-b2 | 0.57 | 0.51 | 0.49 | 0.85 | 0.92 | 0.83 |
| AD-20721-b2 | 0.67 | 0.49 | 0.56 | 0.85 | 0.91 | 0.86 |
| AD-20722-b2 | 0.70 | 0.51 | 0.66 | 0.92 | 0.93 | 0.89 |
| AD-20723-b2 | 0.63 | 0.48 | 0.66 | 0.96 | 1.03 | 1.01 |
| AD-20725-b2 | 0.68 | 0.66 | 0.75 | 0.90 | 0.99 | 1.02 |
| AD-20726-b2 | 0.71 | 0.65 | 0.64 | 1.00 | 0.95 | 1.07 |
| AD-20727-b2 | 0.79 | 0.76 | 0.76 | 0.94 | 0.99 | 0.96 |
| AD-20728-b2 | 0.25 | 0.26 | 0.26 | 0.91 | 1.03 | 0.90 |
| AD-20729-b2 | 0.72 | 0.67 | 0.69 | 1.15 | 1.05 | 0.86 |
| AD-20731-b2 | 0.58 | 0.48 | 0.44 | 1.11 | 1.16 | 1.09 |
| AD-20732-b2 | 0.55 | 0.51 | 0.45 | 0.83 | 1.33 | 0.80 |
| AD-20733-b2 | 0.62 | 0.71 | 0.64 | 1.07 | 0.98 | 1.00 |
| AD-20734-b2 | 0.79 | 0.66 | 0.79 | 0.95 | 0.91 | 1.06 |
| AD-20735-b2 | 0.76 | 0.70 | 0.69 | 1.05 | 1.06 | 1.04 |
| AD-20736-b2 | 0.73 | 0.71 | 0.77 | 1.01 | 0.91 | 1.07 |
| AD-20737-b2 | 0.98 | 0.93 | 1.09 | 1.17 | 0.92 | 1.04 |
| AD-20738-b2 | 0.94 | 0.93 | 0.96 | 1.00 | 1.02 | 1.09 |
| AD-20739-b2 | 1.15 | 0.87 | 1.19 | 1.04 | 0.95 | 1.00 |
| AD-20740-b2 | 0.69 | 0.65 | 0.66 | 1.09 | 1.00 | 1.03 |
| AD-20741-b2 | 1.14 | 0.87 | 1.04 | 1.06 | 1.08 | 1.00 |
| AD-20742-b2 | 0.05 | 0.06 | 0.06 | 0.61 | 0.47 | 0.52 |
| AD-20743-b2 | 0.73 | 1.02 | 0.74 | 0.94 | 1.09 | 0.93 |
| AD-20744-b2 | 0.34 | 0.27 | 0.34 | 1.05 | 1.08 | 1.04 |
| AD-20745-b2 | 0.41 | 0.56 | 0.57 | 1.00 | 0.94 | 1.04 |
| AD-20746-b2 | 0.69 | 0.90 | 0.79 | 0.89 | 0.93 | 0.89 |
| AD-20747-b2 | 0.82 | 0.81 | 0.88 | 1.05 | 1.01 | 1.04 |
| AD-20748-b2 | 0.89 | 0.89 | 0.80 | 0.87 | 1.11 | 1.02 |
| AD-20749-b2 | 0.44 | 0.46 | 0.47 | 1.03 | 0.96 | 0.95 |
| AD-20750-b2 | 0.65 | 0.65 | 0.68 | 1.03 | 0.95 | 1.02 |
| AD-20751-b2 | 0.79 | 0.79 | 0.82 | 1.03 | 0.94 | 0.98 |
| AD-20752-b2 | 0.42 | 0.33 | 0.45 | 0.86 | 0.77 | 0.87 |
| AD-20753-b2 | 0.95 | 1.03 | 1.09 | 1.00 | 1.13 | 0.97 |
| AD-20755-b2 | 0.64 | 0.51 | 0.54 | 1.19 | 1.02 | 1.13 |
| AD-20756-b2 | 0.71 | 0.61 | 0.61 | 1.03 | 1.10 | 1.04 |
| AD-20757-b2 | 0.82 | 0.78 | 0.80 | 1.12 | 1.15 | 0.99 |
| AD-20758-b2 | 0.71 | 0.67 | 0.72 | 0.85 | 0.97 | 1.05 |
| AD-20759-b2 | 0.66 | 0.63 | 0.67 | 0.92 | 0.94 | 1.06 |
| AD-20761-b2 | 0.66 | 0.65 | 0.66 | 0.85 | 0.87 | 0.86 |
| AD-20762-b2 | 0.78 | 0.84 | 0.77 | 0.89 | 0.80 | 0.88 |
| AD-20763-b2 | 1.06 | 0.80 | 1.07 | 0.91 | 1.04 | 0.90 |
| AD-20764-b2 | 0.93 | 0.88 | 0.98 | 0.89 | 0.83 | 0.84 |
| AD-20765-b2 | 0.11 | 0.07 | 0.10 | 0.54 | 0.47 | 0.46 |
| AD-20767-b2 | 0.45 | 0.56 | 0.51 | 0.82 | 0.87 | 0.84 |
| AD-20768-b2 | 0.67 | 0.62 | 0.66 | 0.94 | 1.04 | 0.95 |
| AD-20769-b2 | 1.16 | 1.05 | 0.99 | 1.15 | 1.14 | 0.98 |
| AD-20770-b2 | 0.64 | 0.47 | 0.66 | 1.01 | 1.16 | 1.02 |
| AD-20771-b2 | 0.92 | 0.86 | 0.92 | 0.91 | 0.87 | 0.90 |
| AD-20772-b2 | 0.68 | 0.58 | 0.66 | 1.09 | 1.08 | 0.97 |
| AD-20774-b2 | 0.89 | 0.86 | 0.80 | 1.21 | 0.95 | 0.94 |
| AD-20775-b2 | 0.68 | 0.54 | 0.65 | 1.07 | 1.01 | 1.10 |
| AD-20776-b2 | 0.92 | 0.85 | 0.91 | 1.13 | 1.08 | 1.03 |
| AD-20777-b2 | 0.84 | 0.71 | 0.88 | 1.08 | 0.92 | 1.05 |
| AD-20778-b2 | 0.92 | 0.90 | 0.88 | 1.14 | 0.96 | 0.97 |
| AD-20780-b2 | 1.06 | 0.96 | 1.04 | 1.02 | 1.04 | 1.13 |
| AD-20781-b2 | 1.06 | 1.10 | 1.09 | 1.11 | 0.99 | 1.12 |
| AD-20782-b2 | 0.98 | 1.01 | 1.12 | 1.19 | 1.14 | 1.02 |
| AD-20783-b2 | 1.16 | 0.93 | 1.12 | 1.10 | 1.00 | 1.04 |

TABLE 7-continued

ADDITIONAL SCREENING OF HSF1 siRNAs (10 nM and 0.1 nM)

| Duplex ID | 10 nM Screen 1 (GAPDH) | 10 nM Screen 1 (18s) | 10 nM Screen 2 (GAPDH) | 0.1 nM Screen 1 (GAPDH) | 0.1 nM Screen 1 (18s) | 0.1 nM Screen 2 (GAPDH) |
|---|---|---|---|---|---|---|
| AD-20784-b2 | 0.38 | 0.23 | 0.26 | 1.08 | 1.02 | 0.98 |
| AD-20786-b2 | 0.56 | 0.32 | 0.43 | 1.02 | 0.97 | 0.91 |
| AD-20787-b2 | 0.81 | 0.86 | 0.72 | 1.04 | 0.93 | 1.00 |
| AD-20788-b2 | 1.07 | 0.84 | 1.09 | 0.94 | 1.02 | 1.03 |
| AD-20789-b2 | 1.01 | 0.73 | 1.06 | 1.07 | 0.97 | 1.06 |
| AD-20790-b2 | 0.85 | 0.61 | 0.89 | 0.82 | 0.99 | 0.91 |
| AD-20792-b2 | 1.03 | 0.99 | 1.04 | 1.07 | 1.09 | 1.05 |
| AD-20793-b2 | 1.24 | 0.93 | 1.02 | 1.00 | 1.05 | 0.99 |
| AD-20794-b2 | 1.05 | 0.94 | 1.20 | 1.02 | 1.02 | 1.00 |
| AD-20795-b2 | 1.01 | 0.93 | 1.08 | 1.01 | 1.04 | 0.98 |
| AD-20796-b2 | 1.25 | 1.04 | 1.08 | 0.96 | 1.09 | 0.94 |
| AD-20797-b2 | 1.01 | 1.01 | 0.83 | 1.03 | 1.09 | 1.00 |
| AD-20798-b2 | 0.91 | 0.96 | 1.00 | 1.01 | 1.11 | 0.96 |
| AD-20799-b2 | 0.87 | 0.77 | 0.85 | 1.01 | 1.21 | 1.02 |
| AD-20800-b2 | 1.01 | 0.99 | 1.04 | 1.07 | 1.08 | 0.90 |
| AD-20801-b2 | 0.90 | 0.80 | 0.88 | 0.98 | 0.78 | 0.80 |
| AD-20868-b2 | 0.88 | 0.71 | 0.85 | 1.20 | 0.82 | 0.81 |
| AD-20869-b2 | 0.59 | 0.50 | 0.52 | 1.16 | 1.02 | 0.92 |
| AD-20870-b2 | 0.66 | 0.62 | 0.63 | 1.29 | 0.80 | 0.88 |
| AD-20871-b2 | 1.03 | 0.97 | 1.04 | 1.16 | 0.90 | 0.97 |
| AD-20872-b2 | 0.86 | 0.66 | 0.80 | 1.23 | 0.99 | 0.93 |
| AD-20873-b2 | 0.91 | 0.98 | 0.90 | 1.23 | 0.85 | 0.86 |

Example 7

In Vivo and PBMC Analysis of RNAi Agents

Selected RNAi agents to HSF1 are analyzed in a PBMC (peripheral blood mononuclear cell) assay to estimate immunogenicity; and in vivo in Hep3B (primary liver xenograft) subcutaneous tumors in nude mice. RNAi agents are delivered in vivo in a lipid nanoparticle. Single dosages of 5 mg/kg or 3 mg/kg were delivered, and animals sacrificed and tissues collected 72 hours after dosage. The results are shown below in Table 8.

The Duplex ID indicates the various names for the RNAi agent; AD-XXXXX/AD-XXXXX=dTdT/uu modified version of the same siRNA core sequence indicated. (XXXXX) indicates the duplex ID for the uu sequence. The Target Seq (sequence) and position in the human and cyno (cynomolgus) HSF1 genes are given; "na" indicates that the given sequence is not in the cynomolgus gene. PBMC Result (IFN-α, TNF-α) indicates whether or not a given RNAi elicited an immune response, as indicated by a measured induction of TNF-α, or IFN-α. "quiet" indicates that a given RNAi agent did not illicit an immune response. In the columns labeled "In vivo Hep3B," the numbers indicate the percent knockdown of HSF1 expression.

TABLE 8

In vivo and PBMC analysis of RNAi agents

| Duplex ID | Target Seq (=SS 19-mer) | SEQ ID NO: | Pos Human | Pos Cyno | PBMC Result (IFN-α, TNF-α) | In vivo Hep-3B 5 mg/kg, 72 h | In vivo Hep-3B 3 mg/kg, 72 h |
|---|---|---|---|---|---|---|---|
| AD-20403/ AD-30070 (505) | UUGAGAACAUCAAGAGGAA | 3195 | 505 | na | Quiet | 50% & 70% | 52% |
| AD-20437/ AD-36969 | CCCUGAAGAGUGAAGACAU | 3196 | 541 | 532 | Quiet | 50% | 40% |
| AD-20438 | CCUGAAGAGUGAAGACAUA | 3197 | 542 | 533 | Quiet | 50% | 62% |
| AD-20439 | CUGAAGAGUGAAGACAUAA | 3198 | 543 | 534 | Quiet | 47% | 46% |
| AD-20487/ AD-30071 (544) | UGAAGAGUGAAGACAUAAA | 3199 | 544 | 535 | Quiet | 60-70% | 70% |

TABLE 8-continued

In vivo and PBMC analysis of RNAi agents

| Duplex ID | Target Seq (=SS 19-mer) | SEQ ID NO: | Pos Human | Pos Cyno | PBMC Result (IFN-α, TNF-α) | In vivo Hep-3B 5 mg/kg, 72 h | In vivo Hep-3B 3 mg/kg, 72 h |
|---|---|---|---|---|---|---|---|
| AD-20489/ AD-36970 | AAGAGUGAAGACAUAAAGA | 3200 | 546 | 537 | Mild TNF-α induction | 39% | |
| AD-20490 | AGAGUGAAGACAUAAAGAU | 3201 | 547 | 538 | Quiet | 42% | |
| AD-20491 | GAGUGAAGACAUAAAGAUC | 3202 | 548 | 539 | Quiet | 40% | |
| AD-20548 | GCAGAAGCAUGCCCAGCAA | 3203 | 698 | 689 | Quiet | 40% | |
| AD-20560/ AD-37739 (733) | AGCUCAUUCAGUUCCUGAU | 3204 | 733 | 724 | Quiet | 60% | 50% |
| AD-20562 (735) | CUCAUUCAGUUCCUGAUCU | 3205 | 735 | 726 | Quiet | 50% | 50% |
| AD-20563/ AD-36973 | UCAUUCAGUUCCUGAUCUC | 3206 | 736 | 727 | Quiet | 34% | |
| AD-20564/ AD-36971 | CAUUCAGUUCCUGAUCUCA | 3207 | 737 | 728 | Quiet | 57% | 65% |
| AD-20578 | UCUCACUGGUGCAGUCAAA | 3208 | 751 | 742 | Quiet | 32% | |
| AD-20626 | UGGUGCAGUCAAACCGGAU | 3209 | 757 | 748 | Quiet | 36% | |
| AD-20627 (758) | GGUGCAGUCAAACCGGAUC | 3210 | 758 | 749 | Quiet | 50% | 40% |
| AD-20644 | GAACGACAGUGGCUCAGCA | 3211 | 809 | 800 | Quiet | 17% | |
| AD-20648 | GACAGUGGCUCAGCACAUU | 3212 | 813 | 804 | Quiet | 27% | |
| AD-20652/ AD-36972 | GUGGCUCAGCACAUUCCAU | 3213 | 817 | 808 | Quiet | 28% | |
| AD-20660 (825) | GCACAUUCCAUGCCCAAGU | 3214 | 825 | 816 | Quiet | 50% | 40% |
| AD-20694 | GCGGGAGCAUAGACGAGAG | 3215 | 1012 | 1003 | Quiet | 24% | |
| AD-20707 (1330) | ACUUGGAUGCUAUGGACUC | 3216 | 1330 | 1321 | Quiet | 50% | |
| AD-20730 (1372) | UGCUGAGCAGCCACGGCUU | 3217 | 1372 | 1363 | TNF-α induction | 50% | 47% |

Thus, as shown in the table above, several RNAi agents do not elicit an immune response in the PBMC assay (indicated by "quiet"). Several RNAi agents also elicited at least a 40% HSF1 expression knock-down. AD-20403/30070, AD-20437/ AD-36969, AD-20438, AD-20439, AD-20487/AD-30071 (544), AD-20548, AD-20560/AD-37739 (733), AD-20562 (735), AD-20564/AD-36971, AD-20627 (758), AD-20660 (825), AD-20707 (1330), and AD-20730 (1372) are chosen for lead optimization.

Example 8

5'-End Modifications

This example describes screening multiple chemistries to identify siRNAs that retain or improve activity relative to parent and that are potentially more stable.

A two-phase approach is used. The first phase involves identifying an optimal 5' end cap for S (sense) strand inactivation. End-caps used are: Inverted dT, L-sugar, and C-6-alkyl. These are illustrated in FIG. 1. Each cap is tested for its ability to block siRNA activity when on the 5'-end of antisense (AS) but maintain activity when on the 5'-end of the sense strand using 4 potent HSF1 siRNAs for evaluation. 1050 (EC50) in HeLa cells is determined.

In the second phase, multiple chemical motifs are tested on a larger set of HSF1 siRNAs in context of the best 5'-end cap found in the first phase.

S (sense) modifications include the following:
Endolight, wherein all pyrmidines are modified to 2'-OMe with 2'-OMe uu overhang, and All ribonucleotides are used with 2'-OMe uu overhang.

AS modifications include:
All pyrimidines are modified with to 2'-OMe, with a 2'-OMe uu overhang, Endolight+2'-OMe on 5 3'-terminal bases with 2'-OMe uu overhang Endolight+2'-OMe at only pyrmidines of 5 3' terminal bases, with 2'-OMe uu overhang.

Table 9A and Table 9B provide examples of 5'-end modifications contemplated within the scope of the invention. As depicted in the tables, IC50 I and IC50 II indicate the results of two determinations of IC50 (EC50). The results indicate nM concentrations.

TABLE 9A

Antisense modifications

|  | Duplex ID | Sequence | SEQ ID NO: | IC50 I | IC50 II |
|---|---|---|---|---|---|
| dTdT/uu | AD-20437.4 | cccuGAAGAGuGAAGAcAudTdT<br>AUGUCUUcACUCUUcAGGGdTdT | 3218<br>3219 | 0.014 | 0.016 |
|  | AD-20487.7 | uGAAGAGuGAAGAcAuAAAdTdT<br>UUuAUGUCUUcACUCUUcAdTdT | 3220<br>3221 | 0.003 | 0.004 |
|  | AD-20489.2 | AAGAGuGAAGAcAuAAAGAdTdT<br>UCUUuAUGUCUUcACUCUUdTdT | 3222<br>3223 | 0.005 | 0.005 |
|  | AD-20560.4 | AGcucAuucAGuuccuGAudTdT<br>AUcAGGAACUGAAUGAGCUdTdT | 3224<br>3225 | 0.013 | 0.012 |
| Inverted dT | AD-37718.1 | cccuGAAGAGuGAAGAcAuuu<br>(idT)AUGUCUUcACUCUUcAGGGuu | 3226<br>3227 | 0.126 | 0.220 |
|  | AD-37721.1 | uGAAGAGuGAAGAcAuAAAuu<br>(idT)UUuAUGUCUUcACUCUUcAuu | 3228<br>3229 | 1.800 | >10 |
|  | AD-37724.1 | AAGAGuGAAGAcAuAAAGAuu<br>(idT)UCUUuAUGUCUUcACUCUUuu | 3230<br>3231 | 0.473 | 0.737 |
|  | AD-37727.1 | AGcucAuucAGuuccuGAuuu<br>(idT)AUcAGGAACUGAAUGAGCUuu | 3232<br>3233 | >10 | 3.202 |
| L-sugar | AD-37730.1 | cccuGAAGAGuGAAGAcAuuu<br>AbUGUCUUcACUCUUcAGGGuu | 3234<br>3235 | 0.240 | 0.326 |
|  | AD-37733.1 | uGAAGAGuGAAGAcAuAAAuu<br>UbUuAUGUCUUcACUCUUcAuu | 3236<br>3237 | >10 | 5.649 |
|  | AD-37736.1 | AAGAGuGAAGAcAuAAAGAuu<br>UbCUUuAUGUCUUcACUCUUuu | 3238<br>3239 | 0.157 | 0.254 |
|  | AD-37740.1 | AGcucAuucAGuuccuGAuuu<br>AbUcAGGAACUGAAUGAGCUuu | 3240<br>3241 | 0.028 | 0.064 |
| C-6-alkyl | AD-37719.1 | cccuGAAGAGuGAAGAcAuuu<br>Q128AUGUCUUcACUCUUcAGGGuu | 3242<br>3243 | 0.471 | 0.451 |
|  | AD-37722.1 | uGAAGAGuGAAGAcAuAAAuu<br>Q128UUuAUGUCUUcACUCUUcAuu | 3244<br>3245 | 0.087 | 0.031 |
|  | AD-37725.1 | AAGAGuGAAGAcAuAAAGAuu<br>Q128UCUUuAUGUCUUcACUCUUuu | 3246<br>3247 | 0.013 | 0.017 |
|  | AD-37728.1 | AGcucAuucAGuuccuGAuuu<br>Q128AUcAGGAACUGAAUGAGCUuu | 3248<br>3249 | 0.006 | 0.005 |

TABLE 9B

Sense modifications

|  | Duplex ID | Sequence | SEQ ID NO: | IC50 I | IC50 II |
|---|---|---|---|---|---|
| dTdT/uu | AD-36969.2 | cccuGAAGAGuGAAGAcAuuu<br>AUGUCUUcACUCUUcAGGGuu | 3250<br>3251 | 0.014 | 0.006 |
|  | AD-30071.2 | uGAAGAGuGAAGAcAuAAAuu<br>UUuAUGUCUUcACUCUUcAuu | 3252<br>3253 | 0.003 | 0.006 |

TABLE 9B-continued

Sense modifications

| | Duplex ID | Sequence | SEQ ID NO: | IC50 I | IC50 II |
|---|---|---|---|---|---|
| | AD-36970.2 | AAGAGuGAAGAcAuAAAGAuu<br>UCUUuAUGUCUUcACUCUUuu | 3254<br>3255 | 0.015 | 0.011 |
| | AD-37739.1 | AGcucAuucAGuuccuGAuuu<br>AUcAGGAACUGAAUGAGCUuu | 3256<br>3257 | 0.804 | 0.644 |
| Inverted dT | AD-37731.1 | (idT)cccuGAAGAGuGAAGAcAuuu<br>AUGUCUUcACUCUUcAGGGuu | 3258<br>3259 | 0.012 | 0.008 |
| | AD-37734.1 | (idT)uGAAGAGuGAAGAcAuAAAuu<br>UUuAUGUCUUcACUCUUcAuu | 3260<br>3261 | 0.009 | 0.009 |
| | AD-37737.1 | (idT)AAGAGuGAAGAcAuAAAGAuu<br>UCUUuAUGUCUUcACUCUUuu | 3262<br>3263 | 0.003 | 0.005 |
| | AD-37741.1 | (idT)AGcucAuucAGuuccuGAuuu<br>AUcAGGAACUGAAUGAGCUuu | 3264<br>3265 | 0.005 | 0.008 |
| L-sugar | AD-37720.1 | CbccuGAAGAGuGAAGAcAuuu<br>AUGUCUUcACUCUUcAGGGuu | 3266<br>3267 | 0.004 | 0.004 |
| | AD-37723.1 | UbGAAGAGuGAAGAcAuAAAuu<br>UUuAUGUCUUcACUCUUcAuu | 3268<br>3269 | 0.010 | 0.010 |
| | AD-37726.1 | AbAGAGuGAAGAcAuAAAGAuu<br>UCUUuAUGUCUUcACUCUUuu | 3270<br>3271 | 0.003 | 0.003 |
| | AD-37729.1 | AbGcucAuucAGuuccuGAuuu<br>AUcAGGAACUGAAUGAGCUuu | 3272<br>3273 | 0.006 | 0.010 |
| C-6-alkyl | AD-37732.1 | Q128CccuGAAGAGuGAAGAcAuuu<br>AUGUCUUcACUCUUcAGGGuu | 3274<br>3275 | 0.014 | 0.005 |
| | AD-37735.1 | Q128UGAAGAGuGAAGAcAuAAAuu<br>UUuAUGUCUUcACUCUUcAuu | 3276<br>3277 | | 0.144 |
| | AD-37738.1 | Q128AAGAGuGAAGAcAuAAAGAuu<br>UCUUuAUGUCUUcACUCUUuu | 3278<br>3279 | 0.008 | 0.087 |
| | AD-37742.1 | Q128AGcucAuucAGuuccuGAuuu<br>AUcAGGAACUGAAUGAGCUuu | 3280<br>3281 | 0.010 | 0.020 |

Note that in the above tables, a suffix such as 0.1, 0.2, 0.3, 0.4, etc. indicates a variant of a given RNAi agent. Thus, AD-20437.4 and AD-20437, for example, have the same sequence, though they may vary in modifications, caps, etc. Thus, any references to (including descriptions of various embodiments related to) AD-20437.4; AD-20487.7; AD-20489.2; AD-20560.4; AD-37718.1; AD-37721.1; AD-37724.1; AD-37727.1; AD-37730.1; AD-37733.1; AD-37736.1; AD-37740.1; AD-37719.1; AD-37722.1; AD-37725.1; AD-37728.1; AD-30071.2; AD-36969.2; AD-36970.2; AD-37718.1; AD-37719.1; AD-37720.1; AD-37721.1; AD-37722.1; AD-37723.1; AD-37724.1; AD-37725.1; AD-37726.1; AD-37727.1; AD-37728.1; AD-37729.1; AD-37730.1; AD-37731.1; AD-37732.1; AD-37733.1; AD-37734.1; AD-37735.1; AD-37736.1; AD-37737.1; AD-37738.1; AD-37739.1; AD-37740.1; AD-37741.1; AD-37742.1; also refer, respectively, to: AD-20437; AD-20487; AD-20489.2; AD-20560; AD-37718; AD-37721; AD-37724; AD-37727; AD-37730; AD-37733; AD-37736; AD-37740; AD-37719; AD-37722; AD-37725; AD-37728; AD-30071; AD-36969; AD-36970; AD-37718; AD-37719; AD-37720; AD-37721; AD-37722; AD-37723; AD-37724; AD-37725; AD-37726; AD-37727; AD-37728; AD-37729; AD-37730; AD-37731; AD-37732; AD-37733; AD-37734; AD-37735; AD-37736; AD-37737; AD-37738; AD-37739; AD-37740; AD-37741; and AD-37742. Thus, any grouping of siRNAs of overlapping sequences comprising AD-20437 also comprises AD-20437.4. This is true of other groupings comprising any variant sequence; thus, any grouping of overlapping siRNAs of a given sequence also comprises siRNAs comprising a variant of that sequence, e.g., with modifications and/or caps.

The inverted dT (idT) and L-sugar are found to reduce activity approximately 10- to 100-fold when the antisense strand is modified; there is minimal impact when these modifications are placed on the 5'-end of the sense strand.

Unless defined otherwise, the technical and scientific terms used herein have the same meaning as that usually understood by a specialist familiar with the field to which the disclosure belongs.

Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein. Unless indicated otherwise, each of the references cited herein is incorporated in its entirety by reference.

Claims to the invention are non-limiting and are provided below.

Although particular embodiments and claims have been disclosed herein in detail, this has been done by way of example for purposes of illustration only, and is not intended to be limiting with respect to the scope of the appended claims, or the scope of subject matter of claims of any corresponding future application. In particular, it is contemplated by the inventors that various substitutions, alterations, and modifications may be made to the disclosure without departing from the spirit and scope of the disclosure as defined by the claims. The choice of nucleic acid starting material, clone of interest, or library type is believed to be a matter of routine for a person of ordinary skill in the art with knowledge of the embodiments described herein. Other aspects, advantages, and modifications considered to be within the scope of the following claims. Those skilled in the art will recognize or be able to ascertain, using no more than routine experimentation, many equivalents of the specific embodiments of the invention described herein. Such equivalents are intended to be encompassed by the following claims. Redrafting of claim scope in later filed corresponding applications may be due to limitations by the patent laws of various countries and should not be interpreted as giving up subject matter of the claims.

SEQUENCE LISTING (3288 sequences)

SEQ ID NO: 1 - RNA, 19 nt, Artificial
  siRNA construct
gggcccagcaacgucccgg

SEQ ID NO: 2 - RNA, 19 nt, Artificial
  siRNA construct
ggcccagcaacgucccggc

SEQ ID NO: 3 - RNA, 19 nt, Artificial
  siRNA construct
gcccagcaacgucccggcc

SEQ ID NO: 4 - RNA, 19 nt, Artificial
  siRNA construct
cccagcaacgucccggccu

SEQ ID NO: 5 - RNA, 19 nt, Artificial
  siRNA construct
ccagcaacgucccggccuu

SEQ ID NO: 6 - RNA, 19 nt, Artificial
  siRNA construct
cagcaacgucccggccuuc

SEQ ID NO: 7 - RNA, 19 nt, Artificial
  siRNA construct
agcaacgucccggccuucc

SEQ ID NO: 8 - RNA, 19 nt, Artificial
  siRNA construct
gcaacgucccggccuuccu

SEQ ID NO: 9 - RNA, 19 nt, Artificial
  siRNA construct
caacgucccggccuuccug

SEQ ID NO: 10 - RNA, 19 nt, Artificial
  siRNA construct
aacgucccggccuuccuga

SEQ ID NO: 11 - RNA, 19 nt, Artificial
  siRNA construct
acgucccggccuuccugac

SEQ ID NO: 12 - RNA, 19 nt, Artificial
  siRNA construct
cgucccggccuuccugacc

SEQ ID NO: 13 - RNA, 19 nt, Artificial
  siRNA construct
gucccggccuuccugacca

SEQ ID NO: 14 - RNA, 19 nt, Artificial
  siRNA construct
ccggccuuccugaccaagc

SEQ ID NO: 15 - RNA, 19 nt, Artificial
  siRNA construct
cggccuuccugaccaagcu

SEQ ID NO: 16 - RNA, 19 nt, Artificial
  siRNA construct
ggccuuccugaccaagcug

SEQ ID NO: 17 - RNA, 19 nt, Artificial
  siRNA construct
gccuuccugaccaagcugu

SEQ ID NO: 18 - RNA, 19 nt, Artificial
  siRNA construct
ccuuccugaccaagcugug

SEQ ID NO: 19 - RNA, 19 nt, Artificial
  siRNA construct
cuuccugaccaagcugugg

SEQ ID NO: 20 - RNA, 19 nt, Artificial
  siRNA construct
uuccugaccaagcugugga

SEQ ID NO: 21 - RNA, 19 nt, Artificial
  siRNA construct
uccugaccaagcuguggac

SEQ ID NO: 22 - RNA, 19 nt, Artificial
  siRNA construct
ccugaccaagcuguggacc

SEQ ID NO: 23 - RNA, 19 nt, Artificial
  siRNA construct
cugaccaagcuguggaccc

SEQ ID NO: 24 - RNA, 19 nt, Artificial
  siRNA construct
ugaccaagcuguggacccu

SEQ ID NO: 25 - RNA, 19 nt, Artificial
  siRNA construct
gaccaagcuguggacccuc

SEQ ID NO: 26 - RNA, 19 nt, Artificial
  siRNA construct
accaagcuguggacccucg

SEQ ID NO: 27 - RNA, 19 nt, Artificial
  siRNA construct
ccaagcuguggacccucgu

SEQ ID NO: 28 - RNA, 19 nt, Artificial
  siRNA construct
caagcuguggacccucgug

SEQ ID NO: 29 - RNA, 19 nt, Artificial
  siRNA construct
aagcuguggacccucguga

SEQ ID NO: 30 - RNA, 19 nt, Artificial
  siRNA construct
agcuguggacccucgugag

SEQ ID NO: 31 - RNA, 19 nt, Artificial
  siRNA construct
gcuguggacccucgugagc

SEQ ID NO: 32 - RNA, 19 nt, Artificial
  siRNA construct
cuguggacccucgugagcg

SEQ ID NO: 33 - RNA, 19 nt, Artificial
  siRNA construct
uguggacccucgugagcga

SEQ ID NO: 34 - RNA, 19 nt, Artificial
  siRNA construct
guggacccucgugagcgac

SEQ ID NO: 35 - RNA, 19 nt, Artificial
  siRNA construct
uggacccucgugagcgacc

SEQ ID NO: 36 - RNA, 19 nt, Artificial
  siRNA construct
ggacccucgugagcgaccc

SEQ ID NO: 37 - RNA, 19 nt, Artificial
  siRNA construct
gacccucgugagcgacccg

SEQ ID NO: 38 - RNA, 19 nt, Artificial
  siRNA construct
acccucgugagcgacccgg

SEQ ID NO: 39 - RNA, 19 nt, Artificial
  siRNA construct
cccucgugagcgacccgga

SEQ ID NO: 40 - RNA, 19 nt, Artificial
  siRNA construct
ccucgugagcgacccggac

SEQ ID NO: 41 - RNA, 19 nt, Artificial
  siRNA construct
cucgugagcgacccggaca

SEQ ID NO: 42 - RNA, 19 nt, Artificial
  siRNA construct
ucgugagcgacccggacac

SEQ ID NO: 43 - RNA, 19 nt, Artificial
  siRNA construct
cgugagcgacccggacacc

SEQ ID NO: 44 - RNA, 19 nt, Artificial
  siRNA construct
gugagcgacccggacaccg

SEQ ID NO: 45 - RNA, 19 nt, Artificial
  siRNA construct
ugagcgacccggacaccga

SEQ ID NO: 46 - RNA, 19 nt, Artificial
  siRNA construct
gagcgacccggacaccgac

SEQ ID NO: 47 - RNA, 19 nt, Artificial
  siRNA construct
agcgacccggacaccgacg

SEQ ID NO: 48 - RNA, 19 nt, Artificial
  siRNA construct
gcgacccggacaccgacgc

SEQ ID NO: 49 - RNA, 19 nt, Artificial
  siRNA construct
cucaucugcuggagcccga

SEQ ID NO: 50 - RNA, 19 nt, Artificial
  siRNA construct
ucaucugcuggagcccgag

SEQ ID NO: 51 - RNA, 19 nt, Artificial
  siRNA construct
guguucgaccagggccagu

SEQ ID NO: 52 - RNA, 19 nt, Artificial
  siRNA construct
uguucgaccagggccaguu

SEQ ID NO: 53 - RNA, 19 nt, Artificial
  siRNA construct
guucgaccagggccaguuu

SEQ ID NO: 54 - RNA, 19 nt, Artificial
  siRNA construct
uucgaccagggccaguuug

SEQ ID NO: 55 - RNA, 19 nt, Artificial
  siRNA construct
ucgaccagggccaguuugc

SEQ ID NO: 56 - RNA, 19 nt, Artificial
  siRNA construct
cgaccagggccaguuugcc

SEQ ID NO: 57 - RNA, 19 nt, Artificial
  siRNA construct
gaccagggccaguuugcca

SEQ ID NO: 58 - RNA, 19 nt, Artificial
  siRNA construct
accagggccaguuugccaa

SEQ ID NO: 59 - RNA, 19 nt, Artificial
  siRNA construct
ccagggccaguuugccaag

SEQ ID NO: 60 - RNA, 19 nt, Artificial
  siRNA construct
cagggccaguuugccaagg

SEQ ID NO: 61 - RNA, 19 nt, Artificial
  siRNA construct
agggccaguuugccaagga

SEQ ID NO: 62 - RNA, 19 nt, Artificial
  siRNA construct
gggccaguuugccaaggag

SEQ ID NO: 63 - RNA, 19 nt, Artificial
  siRNA construct
ggccaguuugccaaggagg

SEQ ID NO: 64 - RNA, 19 nt, Artificial
  siRNA construct
gccaguuugccaaggaggu

SEQ ID NO: 65 - RNA, 19 nt, Artificial
  siRNA construct
ccaguuugccaaggaggug

SEQ ID NO: 66 - RNA, 19 nt, Artificial
  siRNA construct
caguuugccaaggaggugc

SEQ ID NO: 67 - RNA, 19 nt, Artificial
  siRNA construct
aguuugccaaggaggugcu

SEQ ID NO: 68 - RNA, 19 nt, Artificial
  siRNA construct
guuugccaaggaggugcug

SEQ ID NO: 69 - RNA, 19 nt, Artificial
  siRNA construct
uuugccaaggaggugcugc

SEQ ID NO: 70 - RNA, 19 nt, Artificial
  siRNA construct
uugccaaggaggugcugcc

SEQ ID NO: 71 - RNA, 19 nt, Artificial
  siRNA construct
ugccaaggaggugcugccc

SEQ ID NO: 72 - RNA, 19 nt, Artificial
  siRNA construct
gccaaggaggugcugccca

SEQ ID NO: 73 - RNA, 19 nt, Artificial
  siRNA construct
ccaaggaggugcugcccaa

SEQ ID NO: 74 - RNA, 19 nt, Artificial
  siRNA construct
caaggaggugcugcccaag

SEQ ID NO: 75 - RNA, 19 nt, Artificial
  siRNA construct
aaggaggugcugcccaagu

SEQ ID NO: 76 - RNA, 19 nt, Artificial
  siRNA construct
aggaggugcugcccaagua

SEQ ID NO: 77 - RNA, 19 nt, Artificial
  siRNA construct
uucaagcacaacaacaugg

SEQ ID NO: 78 - RNA, 19 nt, Artificial
  siRNA construct
ucaagcacaacaacauggc

SEQ ID NO: 79 - RNA, 19 nt, Artificial
  siRNA construct
caagcacaacaacauggcc

SEQ ID NO: 80 - RNA, 19 nt, Artificial
  siRNA construct
aagcacaacaacauggcca

SEQ ID NO: 81 - RNA, 19 nt, Artificial
  siRNA construct
agcacaacaacauggccag

SEQ ID NO: 82 - RNA, 19 nt, Artificial
  siRNA construct
gcacaacaacauggccagc

SEQ ID NO: 83 - RNA, 19 nt, Artificial
  siRNA construct
cacaacaacauggccagcu

SEQ ID NO: 84 - RNA, 19 nt, Artificial
  siRNA construct
acaacaacauggccagcuu

SEQ ID NO: 85 - RNA, 19 nt, Artificial
  siRNA construct
aacaacauggccagcuucg

SEQ ID NO: 86 - RNA, 19 nt, Artificial
  siRNA construct
acaacauggccagcuucgu

SEQ ID NO: 87 - RNA, 19 nt, Artificial
  siRNA construct
caacauggccagcuucgug

SEQ ID NO: 88 - RNA, 19 nt, Artificial
  siRNA construct
aacauggccagcuucgugc

SEQ ID NO: 89 - RNA, 19 nt, Artificial
  siRNA construct
acauggccagcuucgugcg

SEQ ID NO: 90 - RNA, 19 nt, Artificial
  siRNA construct
cauggccagcuucgugcgg

SEQ ID NO: 91 - RNA, 19 nt, Artificial
  siRNA construct
auggccagcuucgugcggc

SEQ ID NO: 92 - RNA, 19 nt, Artificial
  siRNA construct
uggccagcuucgugcggca

SEQ ID NO: 93 - RNA, 19 nt, Artificial
  siRNA construct
uggucaagccagagagaga

SEQ ID NO: 94 - RNA, 19 nt, Artificial
  siRNA construct
ggucaagccagagagagac

SEQ ID NO: 95 - RNA, 19 nt, Artificial
  siRNA construct
gucaagccagagagagacg

SEQ ID NO: 96 - RNA, 19 nt, Artificial
  siRNA construct
ucaagccagagagagacga

SEQ ID NO: 97 - RNA, 19 nt, Artificial
  siRNA construct
caagccagagagagacgac

SEQ ID NO: 98 - RNA, 19 nt, Artificial
  siRNA construct
aagccagagagagacgaca

SEQ ID NO: 99 - RNA, 19 nt, Artificial
  siRNA construct
agccagagagagacgacac

SEQ ID NO: 100 - RNA, 19 nt, Artificial
  siRNA construct
gccagagagagacgacacg

SEQ ID NO: 101 - RNA, 19 nt, Artificial
  siRNA construct
ccagagagagacgacacgg

SEQ ID NO: 102 - RNA, 19 nt, Artificial
  siRNA construct
cagagagagacgacacgga

SEQ ID NO: 103 - RNA, 19 nt, Artificial
  siRNA construct
agagagagacgacacggag

SEQ ID NO: 104 - RNA, 19 nt, Artificial
  siRNA construct
gagagagacgacacggagu

SEQ ID NO: 105 - RNA, 19 nt, Artificial
  siRNA construct
agagagacgacacggaguu

SEQ ID NO: 106 - RNA, 19 nt, Artificial
  siRNA construct
gagagacgacacggaguuc

SEQ ID NO: 107 - RNA, 19 nt, Artificial
  siRNA construct
agagacgacacggaguucc

SEQ ID NO: 108 - RNA, 19 nt, Artificial
  siRNA construct
gagacgacacggaguucca

SEQ ID NO: 109 - RNA, 19 nt, Artificial
  siRNA construct
agacgacacggaguuccag

SEQ ID NO: 110 - RNA, 19 nt, Artificial
  siRNA construct
gacgacacggaguuccagc

SEQ ID NO: 111 - RNA, 19 nt, Artificial
  siRNA construct
acgacacggaguuccagca

SEQ ID NO: 112 - RNA, 19 nt, Artificial
  siRNA construct
cgacacggaguuccagcac

SEQ ID NO: 113 - RNA, 19 nt, Artificial
  siRNA construct
gacacggaguuccagcacc

SEQ ID NO: 114 - RNA, 19 nt, Artificial
  siRNA construct
acacggaguuccagcaccc

SEQ ID NO: 115 - RNA, 19 nt, Artificial
  siRNA construct
ggccaggagcagcuccuug

SEQ ID NO: 116 - RNA, 19 nt, Artificial
  siRNA construct
gccaggagcagcuccuuga

SEQ ID NO: 117 - RNA, 19 nt, Artificial
  siRNA construct
ccaggagcagcuccuugag

SEQ ID NO: 118 - RNA, 19 nt, Artificial
  siRNA construct
caggagcagcuccuugaga

SEQ ID NO: 119 - RNA, 19 nt, Artificial
  siRNA construct
aggagcagcuccuugagaa

SEQ ID NO: 120 - RNA, 19 nt, Artificial
  siRNA construct
ggagcagcuccuugagaac

SEQ ID NO: 121 - RNA, 19 nt, Artificial
  siRNA construct
gagcagcuccuugagaaca

SEQ ID NO: 122 - RNA, 19 nt, Artificial
  siRNA construct
agcagcuccuugagaacau

SEQ ID NO: 123 - RNA, 19 nt, Artificial
  siRNA construct
gcagcuccuugagaacauc

SEQ ID NO: 124 - RNA, 19 nt, Artificial
  siRNA construct
cagcuccuugagaacauca

SEQ ID NO: 125 - RNA, 19 nt, Artificial
  siRNA construct
agcuccuugagaacaucaa

SEQ ID NO: 126 - RNA, 19 nt, Artificial
  siRNA construct
gcuccuugagaacaucaag

SEQ ID NO: 127 - RNA, 19 nt, Artificial
  siRNA construct
cuccuugagaacaucaaga

SEQ ID NO: 128 - RNA, 19 nt, Artificial
  siRNA construct
uccuugagaacaucaagag

SEQ ID NO: 129 - RNA, 19 nt, Artificial
  siRNA construct
ccuugagaacaucaagagg

SEQ ID NO: 130 - RNA, 19 nt, Artificial
  siRNA construct
cuugagaacaucaagagga

SEQ ID NO: 131 - RNA, 19 nt, Artificial
  siRNA construct
uugagaacaucaagaggaa

SEQ ID NO: 132 - RNA, 19 nt, Artificial
  siRNA construct
ugagaacaucaagaggaaa

SEQ ID NO: 133 - RNA, 19 nt, Artificial
  siRNA construct
gagaacaucaagaggaaag

SEQ ID NO: 134 - RNA, 19 nt, Artificial
  siRNA construct
agaacaucaagaggaaagu

SEQ ID NO: 135 - RNA, 19 nt, Artificial
  siRNA construct
gaacaucaagaggaaagug

SEQ ID NO: 136 - RNA, 19 nt, Artificial
  siRNA construct
aacaucaagaggaaaguga

SEQ ID NO: 137 - RNA, 19 nt, Artificial
  siRNA construct
acaucaagaggaaagugac

SEQ ID NO: 138 - RNA, 19 nt, Artificial
  siRNA construct
caucaagaggaaagugacc

SEQ ID NO: 139 - RNA, 19 nt, Artificial
  siRNA construct
aucaagaggaaagugacca

SEQ ID NO: 140 - RNA, 19 nt, Artificial
  siRNA construct
ucaagaggaaagugaccag

SEQ ID NO: 141 - RNA, 19 nt, Artificial
  siRNA construct
caagaggaaagugaccagu

SEQ ID NO: 142 - RNA, 19 nt, Artificial
  siRNA construct
aagaggaaagugaccagug

SEQ ID NO: 143 - RNA, 19 nt, Artificial
  siRNA construct
gaggaaagugaccagugug

SEQ ID NO: 144 - RNA, 19 nt, Artificial
  siRNA construct
aggaaagugaccagugugu

SEQ ID NO: 145 - RNA, 19 nt, Artificial
  siRNA construct
ggaaagugaccaguguguc

SEQ ID NO: 146 - RNA, 19 nt, Artificial
  siRNA construct
gaaagugaccagugugucc

SEQ ID NO: 147 - RNA, 19 nt, Artificial
  siRNA construct
aaagugaccagugugucca

SEQ ID NO: 148 - RNA, 19 nt, Artificial
  siRNA construct
aagugaccaguguguccac

SEQ ID NO: 149 - RNA, 19 nt, Artificial
  siRNA construct
agugaccaguguguccacc

SEQ ID NO: 150 - RNA, 19 nt, Artificial
  siRNA construct
gugaccaguguguccaccc

SEQ ID NO: 151 - RNA, 19 nt, Artificial
  siRNA construct
ugaccaguguguccacccu

SEQ ID NO: 152 - RNA, 19 nt, Artificial
  siRNA construct
gaccaguguguccacccug

SEQ ID NO: 153 - RNA, 19 nt, Artificial
  siRNA construct
accaguguguccacccuga

SEQ ID NO: 154 - RNA, 19 nt, Artificial
  siRNA construct
ccaguguguccacccugaa

SEQ ID NO: 155 - RNA, 19 nt, Artificial
  siRNA construct
caguguguccacccugaag

SEQ ID NO: 156 - RNA, 19 nt, Artificial
  siRNA construct
aguguguccacccugaaga

SEQ ID NO: 157 - RNA, 19 nt, Artificial
  siRNA construct
guguguccacccugaagag

SEQ ID NO: 158 - RNA, 19 nt, Artificial
  siRNA construct
uguguccacccugaagagu

SEQ ID NO: 159 - RNA, 19 nt, Artificial
  siRNA construct
guguccacccugaagagug

SEQ ID NO: 160 - RNA, 19 nt, Artificial
  siRNA construct
uguccacccugaagaguga

SEQ ID NO: 161 - RNA, 19 nt, Artificial
  siRNA construct
guccacccugaagagugaa

SEQ ID NO: 162 - RNA, 19 nt, Artificial
  siRNA construct
uccacccugaagagugaag

SEQ ID NO: 163 - RNA, 19 nt, Artificial
  siRNA construct
ccacccugaagagugaaga

SEQ ID NO: 164 - RNA, 19 nt, Artificial
  siRNA construct
cacccugaagagugaagac

SEQ ID NO: 165 - RNA, 19 nt, Artificial
  siRNA construct
acccugaagagugaagaca

SEQ ID NO: 166 - RNA, 19 nt, Artificial
  siRNA construct
cccugaagagugaagacau

SEQ ID NO: 167 - RNA, 19 nt, Artificial
  siRNA construct
ccugaagagugaagacaua

SEQ ID NO: 168 - RNA, 19 nt, Artificial
  siRNA construct
cugaagagugaagacauaa

SEQ ID NO: 169 - RNA, 19 nt, Artificial
  siRNA construct
ugaagagugaagacauaaa

SEQ ID NO: 170 - RNA, 19 nt, Artificial
  siRNA construct
gaagagugaagacauaaag

SEQ ID NO: 171 - RNA, 19 nt, Artificial
  siRNA construct
aagagugaagacauaaaga

SEQ ID NO: 172 - RNA, 19 nt, Artificial
  siRNA construct
agagugaagacauaaagau

SEQ ID NO: 173 - RNA, 19 nt, Artificial
  siRNA construct
gagugaagacauaaagauc

SEQ ID NO: 174 - RNA, 19 nt, Artificial
  siRNA construct
agugaagacauaaagaucc

SEQ ID NO: 175 - RNA, 19 nt, Artificial
  siRNA construct
gugaagacauaaagauccg

SEQ ID NO: 176 - RNA, 19 nt, Artificial
  siRNA construct
gucaccaagcugcugacgg

SEQ ID NO: 177 - RNA, 19 nt, Artificial
  siRNA construct
ucaccaagcugcugacgga

SEQ ID NO: 178 - RNA, 19 nt, Artificial
  siRNA construct
caccaagcugcugacggac

SEQ ID NO: 179 - RNA, 19 nt, Artificial
  siRNA construct
accaagcugcugacggacg

SEQ ID NO: 180 - RNA, 19 nt, Artificial
  siRNA construct
ccaagcugcugacggacgu

SEQ ID NO: 181 - RNA, 19 nt, Artificial
  siRNA construct
caagcugcugacggacgug

SEQ ID NO: 182 - RNA, 19 nt, Artificial
  siRNA construct
aagcugcugacggacgugc

SEQ ID NO: 183 - RNA, 19 nt, Artificial
  siRNA construct
agcugcugacggacgugca

SEQ ID NO: 184 - RNA, 19 nt, Artificial
  siRNA construct
gcugcugacggacgugcag

SEQ ID NO: 185 - RNA, 19 nt, Artificial
  siRNA construct
cugcugacggacgugcagc

SEQ ID NO: 186 - RNA, 19 nt, Artificial
  siRNA construct
ugcugacggacgugcagcu

SEQ ID NO: 187 - RNA, 19 nt, Artificial
  siRNA construct
gcugacggacgugcagcug

SEQ ID NO: 188 - RNA, 19 nt, Artificial
  siRNA construct
cugacggacgugcagcuga

SEQ ID NO: 189 - RNA, 19 nt, Artificial
  siRNA construct
ugacggacgugcagcugau

SEQ ID NO: 190 - RNA, 19 nt, Artificial
  siRNA construct
gacggacgugcagcugaug

SEQ ID NO: 191 - RNA, 19 nt, Artificial
  siRNA construct
acggacgugcagcugauga

SEQ ID NO: 192 - RNA, 19 nt, Artificial
  siRNA construct
cggacgugcagcugaugaa

SEQ ID NO: 193 - RNA, 19 nt, Artificial
  siRNA construct
ggacgugcagcugaugaag

SEQ ID NO: 194 - RNA, 19 nt, Artificial
  siRNA construct
gacgugcagcugaugaagg

SEQ ID NO: 195 - RNA, 19 nt, Artificial
  siRNA construct
acgugcagcugaugaaggg

SEQ ID NO: 196 - RNA, 19 nt, Artificial
  siRNA construct
gagaaugaggcucuguggc

SEQ ID NO: 197 - RNA, 19 nt, Artificial
  siRNA construct
agaaugaggcucuguggcg

SEQ ID NO: 198 - RNA, 19 nt, Artificial
  siRNA construct
gaaugaggcucuguggcgg

SEQ ID NO: 199 - RNA, 19 nt, Artificial
  siRNA construct
aaugaggcucuguggcggg

SEQ ID NO: 200 - RNA, 19 nt, Artificial
  siRNA construct
augaggcucuguggcggga

SEQ ID NO: 201 - RNA, 19 nt, Artificial
  siRNA construct
ugaggcucuguggcgggag

SEQ ID NO: 202 - RNA, 19 nt, Artificial
  siRNA construct
gaggcucuguggcgggagg

SEQ ID NO: 203 - RNA, 19 nt, Artificial
  siRNA construct
aggcucuguggcgggaggu

SEQ ID NO: 204 - RNA, 19 nt, Artificial
  siRNA construct
ggcucuguggcgggaggug

SEQ ID NO: 205 - RNA, 19 nt, Artificial
  siRNA construct
gcucuguggcgggaggugg

SEQ ID NO: 206 - RNA, 19 nt, Artificial
  siRNA construct
cucuguggcgggagguggc

SEQ ID NO: 207 - RNA, 19 nt, Artificial
  siRNA construct
ucuguggcgggagguggcc

SEQ ID NO: 208 - RNA, 19 nt, Artificial
  siRNA construct
cuguggcgggagguggcca

SEQ ID NO: 209 - RNA, 19 nt, Artificial
  siRNA construct
uguggcgggagguggccag

SEQ ID NO: 210 - RNA, 19 nt, Artificial
  siRNA construct
guggcgggagguggccagc

SEQ ID NO: 211 - RNA, 19 nt, Artificial
  siRNA construct
uggcgggagguggccagcc

SEQ ID NO: 212 - RNA, 19 nt, Artificial
  siRNA construct
ggcgggagguggccagccu

SEQ ID NO: 213 - RNA, 19 nt, Artificial
  siRNA construct
gcgggagguggccagccuu

SEQ ID NO: 214 - RNA, 19 nt, Artificial
  siRNA construct
cgggagguggccagccuuc

SEQ ID NO: 215 - RNA, 19 nt, Artificial
  siRNA construct
gggagguggccagccuucg

SEQ ID NO: 216 - RNA, 19 nt, Artificial
  siRNA construct
ggagguggccagccuucgg

SEQ ID NO: 217 - RNA, 19 nt, Artificial
  siRNA construct
gagguggccagccuucggc

SEQ ID NO: 218 - RNA, 19 nt, Artificial
  siRNA construct
agguggccagccuucggca

SEQ ID NO: 219 - RNA, 19 nt, Artificial
  siRNA construct
gguggccagccuucggcag

SEQ ID NO: 220 - RNA, 19 nt, Artificial
  siRNA construct
guggccagccuucggcaga

SEQ ID NO: 221 - RNA, 19 nt, Artificial
  siRNA construct
uggccagccuucggcagaa

SEQ ID NO: 222 - RNA, 19 nt, Artificial
  siRNA construct
ggccagccuucggcagaag

SEQ ID NO: 223 - RNA, 19 nt, Artificial
  siRNA construct
gccagccuucggcagaagc

SEQ ID NO: 224 - RNA, 19 nt, Artificial
  siRNA construct
ccagccuucggcagaagca

SEQ ID NO: 225 - RNA, 19 nt, Artificial
  siRNA construct
cagccuucggcagaagcau

SEQ ID NO: 226 - RNA, 19 nt, Artificial
  siRNA construct
agccuucggcagaagcaug

SEQ ID NO: 227 - RNA, 19 nt, Artificial
  siRNA construct
gccuucggcagaagcaugc

SEQ ID NO: 228 - RNA, 19 nt, Artificial
  siRNA construct
ccuucggcagaagcaugcc

SEQ ID NO: 229 - RNA, 19 nt, Artificial
  siRNA construct
cuucggcagaagcaugccc

SEQ ID NO: 230 - RNA, 19 nt, Artificial
  siRNA construct
uucggcagaagcaugccca

SEQ ID NO: 231 - RNA, 19 nt, Artificial
  siRNA construct
ucggcagaagcaugcccag

SEQ ID NO: 232 - RNA, 19 nt, Artificial
  siRNA construct
cggcagaagcaugcccagc

SEQ ID NO: 233 - RNA, 19 nt, Artificial
  siRNA construct
ggcagaagcaugcccagca

SEQ ID NO: 234 - RNA, 19 nt, Artificial
  siRNA construct
gcagaagcaugcccagcaa

SEQ ID NO: 235 - RNA, 19 nt, Artificial
  siRNA construct
cagaagcaugcccagcaac

SEQ ID NO: 236 - RNA, 19 nt, Artificial
  siRNA construct
agaagcaugcccagcaaca

SEQ ID NO: 237 - RNA, 19 nt, Artificial
  siRNA construct
gaagcaugcccagcaacag

SEQ ID NO: 238 - RNA, 19 nt, Artificial
  siRNA construct
aagcaugcccagcaacaga

SEQ ID NO: 239 - RNA, 19 nt, Artificial
  siRNA construct
agcaugcccagcaacagaa

SEQ ID NO: 240 - RNA, 19 nt, Artificial
  siRNA construct
gcaugcccagcaacagaaa

SEQ ID NO: 241 - RNA, 19 nt, Artificial
  siRNA construct
caugcccagcaacagaaag

SEQ ID NO: 242 - RNA, 19 nt, Artificial
  siRNA construct
augcccagcaacagaaagu

SEQ ID NO: 243 - RNA, 19 nt, Artificial
  siRNA construct
ugcccagcaacagaaaguc

SEQ ID NO: 244 - RNA, 19 nt, Artificial
  siRNA construct
gcccagcaacagaaagucg

SEQ ID NO: 245 - RNA, 19 nt, Artificial
  siRNA construct
cccagcaacagaaagucgu

SEQ ID NO: 246 - RNA, 19 nt, Artificial
  siRNA construct
ccagcaacagaaagucguc

SEQ ID NO: 247 - RNA, 19 nt, Artificial
  siRNA construct
cagcaacagaaagucguca

SEQ ID NO: 248 - RNA, 19 nt, Artificial
  siRNA construct
agcaacagaaagucgucaa

SEQ ID NO: 249 - RNA, 19 nt, Artificial
  siRNA construct
gcaacagaaagucgucaac

SEQ ID NO: 250 - RNA, 19 nt, Artificial
  siRNA construct
caacagaaagucgucaaca

SEQ ID NO: 251 - RNA, 19 nt, Artificial
  siRNA construct
aacagaaagucgucaacaa

SEQ ID NO: 252 - RNA, 19 nt, Artificial
  siRNA construct
acagaaagucgucaacaag

SEQ ID NO: 253 - RNA, 19 nt, Artificial
  siRNA construct
cagaaagucgucaacaagc

SEQ ID NO: 254 - RNA, 19 nt, Artificial
  siRNA construct
agaaagucgucaacaagcu

SEQ ID NO: 255 - RNA, 19 nt, Artificial
  siRNA construct
gaaagucgucaacaagcuc

SEQ ID NO: 256 - RNA, 19 nt, Artificial
  siRNA construct
aaagucgucaacaagcuca

SEQ ID NO: 257 - RNA, 19 nt, Artificial
  siRNA construct
aagucgucaacaagcucau

SEQ ID NO: 258 - RNA, 19 nt, Artificial
  siRNA construct
agucgucaacaagcucauu

SEQ ID NO: 259 - RNA, 19 nt, Artificial
  siRNA construct
gucgucaacaagcucauuc

SEQ ID NO: 260 - RNA, 19 nt, Artificial
  siRNA construct
ucgucaacaagcucauuca

SEQ ID NO: 261 - RNA, 19 nt, Artificial
  siRNA construct
cgucaacaagcucauucag

SEQ ID NO: 262 - RNA, 19 nt, Artificial
  siRNA construct
gucaacaagcucauucagu

SEQ ID NO: 263 - RNA, 19 nt, Artificial
  siRNA construct
ucaacaagcucauucaguu

SEQ ID NO: 264 - RNA, 19 nt, Artificial
  siRNA construct
caacaagcucauucaguuc

SEQ ID NO: 265 - RNA, 19 nt, Artificial
  siRNA construct
aacaagcucauucaguucc

SEQ ID NO: 266 - RNA, 19 nt, Artificial
  siRNA construct
acaagcucauucaguuccu

SEQ ID NO: 267 - RNA, 19 nt, Artificial
  siRNA construct
caagcucauucaguuccug

SEQ ID NO: 268 - RNA, 19 nt, Artificial
  siRNA construct
aagcucauucaguuccuga

SEQ ID NO: 269 - RNA, 19 nt, Artificial
  siRNA construct
agcucauucaguuccugau

SEQ ID NO: 270 - RNA, 19 nt, Artificial
  siRNA construct
gcucauucaguuccugauc

SEQ ID NO: 271 - RNA, 19 nt, Artificial
  siRNA construct
cucauucaguuccugaucu

SEQ ID NO: 272 - RNA, 19 nt, Artificial
  siRNA construct
ucauucaguuccugaucuc

SEQ ID NO: 273 - RNA, 19 nt, Artificial
  siRNA construct
cauucaguuccugaucuca

SEQ ID NO: 274 - RNA, 19 nt, Artificial
  siRNA construct
auucaguuccugaucucac

SEQ ID NO: 275 - RNA, 19 nt, Artificial
  siRNA construct
uucaguuccugaucucacu

SEQ ID NO: 276 - RNA, 19 nt, Artificial
  siRNA construct
ucaguuccugaucucacug

SEQ ID NO: 277 - RNA, 19 nt, Artificial
  siRNA construct
caguuccugaucucacugg

SEQ ID NO: 278 - RNA, 19 nt, Artificial
  siRNA construct
aguuccugaucucacuggu

SEQ ID NO: 279 - RNA, 19 nt, Artificial
  siRNA construct
uuccugaucucacuggugc

SEQ ID NO: 280 - RNA, 19 nt, Artificial
  siRNA construct
uccugaucucacuggugca

SEQ ID NO: 281 - RNA, 19 nt, Artificial
  siRNA construct
ccugaucucacuggugcag

SEQ ID NO: 282 - RNA, 19 nt, Artificial
  siRNA construct
ugaucucacuggugcaguc

SEQ ID NO: 283 - RNA, 19 nt, Artificial
  siRNA construct
gaucucacuggugcaguca

SEQ ID NO: 284 - RNA, 19 nt, Artificial
  siRNA construct
aucucacuggugcagucaa

SEQ ID NO: 285 - RNA, 19 nt, Artificial
  siRNA construct
ucucacuggugcagucaaa

SEQ ID NO: 286 - RNA, 19 nt, Artificial
  siRNA construct
cucacuggugcagucaaac

SEQ ID NO: 287 - RNA, 19 nt, Artificial
  siRNA construct
cacuggugcagucaaaccg

SEQ ID NO: 288 - RNA, 19 nt, Artificial
  siRNA construct
acuggugcagucaaaccgg

SEQ ID NO: 289 - RNA, 19 nt, Artificial
  siRNA construct
cuggugcagucaaaccgga

SEQ ID NO: 290 - RNA, 19 nt, Artificial
  siRNA construct
uggugcagucaaaccggau

SEQ ID NO: 291 - RNA, 19 nt, Artificial
  siRNA construct
ggugcagucaaaccggauc

SEQ ID NO: 292 - RNA, 19 nt, Artificial
  siRNA construct
gugcagucaaaccggaucc

SEQ ID NO: 293 - RNA, 19 nt, Artificial
  siRNA construct
ugcagucaaaccggauccu

SEQ ID NO: 294 - RNA, 19 nt, Artificial
  siRNA construct
gcagucaaaccggauccug

SEQ ID NO: 295 - RNA, 19 nt, Artificial
  siRNA construct
cagucaaaccggauccugg

SEQ ID NO: 296 - RNA, 19 nt, Artificial
  siRNA construct
agucaaaccggauccuggg

SEQ ID NO: 297 - RNA, 19 nt, Artificial
  siRNA construct
gggugaagagaaagauccc

SEQ ID NO: 298 - RNA, 19 nt, Artificial
  siRNA construct
cccugaugcugaacgacag

SEQ ID NO: 299 - RNA, 19 nt, Artificial
  siRNA construct
ccugaugcugaacgacagu

SEQ ID NO: 300 - RNA, 19 nt, Artificial
  siRNA construct
cugaugcugaacgacagug

SEQ ID NO: 301 - RNA, 19 nt, Artificial
  siRNA construct
ugaugcugaacgacagugg

SEQ ID NO: 302 - RNA, 19 nt, Artificial
  siRNA construct
gaugcugaacgacaguggc

SEQ ID NO: 303 - RNA, 19 nt, Artificial
  siRNA construct
augcugaacgacaguggcu

SEQ ID NO: 304 - RNA, 19 nt, Artificial
  siRNA construct
ugcugaacgacaguggcuc

SEQ ID NO: 305 - RNA, 19 nt, Artificial
  siRNA construct
gcugaacgacaguggcuca

SEQ ID NO: 306 - RNA, 19 nt, Artificial
  siRNA construct
cugaacgacaguggcucag

SEQ ID NO: 307 - RNA, 19 nt, Artificial
  siRNA construct
ugaacgacaguggcucagc

SEQ ID NO: 308 - RNA, 19 nt, Artificial
  siRNA construct
gaacgacaguggcucagca

SEQ ID NO: 309 - RNA, 19 nt, Artificial
  siRNA construct
aacgacaguggcucagcac

SEQ ID NO: 310 - RNA, 19 nt, Artificial
  siRNA construct
acgacaguggcucagcaca

SEQ ID NO: 311 - RNA, 19 nt, Artificial
  siRNA construct
cgacaguggcucagcacau

SEQ ID NO: 312 - RNA, 19 nt, Artificial
  siRNA construct
gacaguggcucagcacauu

SEQ ID NO: 313 - RNA, 19 nt, Artificial
  siRNA construct
acaguggcucagcacauuc

SEQ ID NO: 314 - RNA, 19 nt, Artificial
  siRNA construct
caguggcucagcacauucc

SEQ ID NO: 315 - RNA, 19 nt, Artificial
  siRNA construct
aguggcucagcacauucca

SEQ ID NO: 316 - RNA, 19 nt, Artificial
  siRNA construct
guggcucagcacauuccau

SEQ ID NO: 317 - RNA, 19 nt, Artificial
  siRNA construct
uggcucagcacauuccaug

SEQ ID NO: 318 - RNA, 19 nt, Artificial
  siRNA construct
ggcucagcacauuccaugc

SEQ ID NO: 319 - RNA, 19 nt, Artificial
  siRNA construct
gcucagcacauuccaugcc

SEQ ID NO: 320 - RNA, 19 nt, Artificial
  siRNA construct
cucagcacauuccaugccc

SEQ ID NO: 321 - RNA, 19 nt, Artificial
  siRNA construct
ucagcacauuccaugccca

SEQ ID NO: 322 - RNA, 19 nt, Artificial
  siRNA construct
cagcacauuccaugcccaa

SEQ ID NO: 323 - RNA, 19 nt, Artificial
  siRNA construct
agcacauuccaugcccaag

SEQ ID NO: 324 - RNA, 19 nt, Artificial
  siRNA construct
gcacauuccaugcccaagu

SEQ ID NO: 325 - RNA, 19 nt, Artificial
  siRNA construct
cacauuccaugcccaagua

SEQ ID NO: 326 - RNA, 19 nt, Artificial
  siRNA construct
acauuccaugcccaaguau

SEQ ID NO: 327 - RNA, 19 nt, Artificial
  siRNA construct
gccggcaguucucccugga

SEQ ID NO: 328 - RNA, 19 nt, Artificial
  siRNA construct
ccggcaguucucccuggag

SEQ ID NO: 329 - RNA, 19 nt, Artificial
  siRNA construct
cggcaguucucccuggagc

SEQ ID NO: 330 - RNA, 19 nt, Artificial
  siRNA construct
ggcaguucucccuggagca

SEQ ID NO: 331 - RNA, 19 nt, Artificial
  siRNA construct
gcaguucucccuggagcac

SEQ ID NO: 332 - RNA, 19 nt, Artificial
  siRNA construct
caguucucccuggagcacg

SEQ ID NO: 333 - RNA, 19 nt, Artificial
  siRNA construct
aguucucccuggagcacgu

SEQ ID NO: 334 - RNA, 19 nt, Artificial
  siRNA construct
guucucccuggagcacguc

SEQ ID NO: 335 - RNA, 19 nt, Artificial
  siRNA construct
uucucccuggagcacgucc

SEQ ID NO: 336 - RNA, 19 nt, Artificial
  siRNA construct
ucucccuggagcacgucca

SEQ ID NO: 337 - RNA, 19 nt, Artificial
  siRNA construct
cucccuggagcacguccac

SEQ ID NO: 338 - RNA, 19 nt, Artificial
  siRNA construct
ucccuggagcacguccacg

SEQ ID NO: 339 - RNA, 19 nt, Artificial
  siRNA construct
cccuggagcacguccacgg

SEQ ID NO: 340 - RNA, 19 nt, Artificial
  siRNA construct
ccuggagcacguccacggc

SEQ ID NO: 341 - RNA, 19 nt, Artificial
  siRNA construct
cuggagcacguccacggcu

SEQ ID NO: 342 - RNA, 19 nt, Artificial
  siRNA construct
uggagcacguccacggcuc

SEQ ID NO: 343 - RNA, 19 nt, Artificial
  siRNA construct
ggagcacguccacggcucg

SEQ ID NO: 344 - RNA, 19 nt, Artificial
  siRNA construct
gagcacguccacggcucgg

SEQ ID NO: 345 - RNA, 19 nt, Artificial
  siRNA construct
agcacguccacggcucggg

SEQ ID NO: 346 - RNA, 19 nt, Artificial
  siRNA construct
gcacguccacggcucgggc

SEQ ID NO: 347 - RNA, 19 nt, Artificial
  siRNA construct
cacguccacggcucgggcc

SEQ ID NO: 348 - RNA, 19 nt, Artificial
  siRNA construct
acguccacggcucgggccc

SEQ ID NO: 349 - RNA, 19 nt, Artificial
  siRNA construct
agcuccagccucuacgccc

SEQ ID NO: 350 - RNA, 19 nt, Artificial
  siRNA construct
ggacccaucaucuccgaca

SEQ ID NO: 351 - RNA, 19 nt, Artificial
  siRNA construct
gacccaucaucuccgacau

SEQ ID NO: 352 - RNA, 19 nt, Artificial
  siRNA construct
acccaucaucuccgacauc

SEQ ID NO: 353 - RNA, 19 nt, Artificial
  siRNA construct
cccaucaucuccgacauca

SEQ ID NO: 354 - RNA, 19 nt, Artificial
  siRNA construct
ccaucaucuccgacaucac

SEQ ID NO: 355 - RNA, 19 nt, Artificial
  siRNA construct
caucaucuccgacaucacc

SEQ ID NO: 356 - RNA, 19 nt, Artificial
  siRNA construct
aucaucuccgacaucaccg

SEQ ID NO: 357 - RNA, 19 nt, Artificial
  siRNA construct
ucaucuccgacaucaccga

SEQ ID NO: 358 - RNA, 19 nt, Artificial
  siRNA construct
caucuccgacaucaccgag

SEQ ID NO: 359 - RNA, 19 nt, Artificial
  siRNA construct
aucuccgacaucaccgagc

SEQ ID NO: 360 - RNA, 19 nt, Artificial
  siRNA construct
ucuccgacaucaccgagcu

SEQ ID NO: 361 - RNA, 19 nt, Artificial
  siRNA construct
cuccgacaucaccgagcug

SEQ ID NO: 362 - RNA, 19 nt, Artificial
  siRNA construct
uccgacaucaccgagcugg

SEQ ID NO: 363 - RNA, 19 nt, Artificial
  siRNA construct
ccgacaucaccgagcuggc

SEQ ID NO: 364 - RNA, 19 nt, Artificial
  siRNA construct
cgacaucaccgagcuggcu

SEQ ID NO: 365 - RNA, 19 nt, Artificial
  siRNA construct
gacaucaccgagcuggcuc

SEQ ID NO: 366 - RNA, 19 nt, Artificial
  siRNA construct
acaucaccgagcuggcucc

SEQ ID NO: 367 - RNA, 19 nt, Artificial
  siRNA construct
caucaccgagcuggcuccu

SEQ ID NO: 368 - RNA, 19 nt, Artificial
  siRNA construct
aucaccgagcuggcuccug

SEQ ID NO: 369 - RNA, 19 nt, Artificial
  siRNA construct
ucaccgagcuggcuccugc

SEQ ID NO: 370 - RNA, 19 nt, Artificial
  siRNA construct
caccgagcuggcuccugcc

SEQ ID NO: 371 - RNA, 19 nt, Artificial
  siRNA construct
accgagcuggcuccugcca

SEQ ID NO: 372 - RNA, 19 nt, Artificial
  siRNA construct
ccgagcuggcuccugccag

SEQ ID NO: 373 - RNA, 19 nt, Artificial
  siRNA construct
cgagcuggcuccugccagc

SEQ ID NO: 374 - RNA, 19 nt, Artificial
  siRNA construct
gagcuggcuccugccagcc

SEQ ID NO: 375 - RNA, 19 nt, Artificial
  siRNA construct
agcuggcuccugccagccc

SEQ ID NO: 376 - RNA, 19 nt, Artificial
  siRNA construct
ggcgggagcauagacgaga

SEQ ID NO: 377 - RNA, 19 nt, Artificial
  siRNA construct
gcgggagcauagacgagag

SEQ ID NO: 378 - RNA, 19 nt, Artificial
  siRNA construct
cgggagcauagacgagagg

SEQ ID NO: 379 - RNA, 19 nt, Artificial
  siRNA construct
gggagcauagacgagaggc

SEQ ID NO: 380 - RNA, 19 nt, Artificial
  siRNA construct
ggagcauagacgagaggcc

SEQ ID NO: 381 - RNA, 19 nt, Artificial
  siRNA construct
gagcauagacgagaggccc

SEQ ID NO: 382 - RNA, 19 nt, Artificial
  siRNA construct
cccuggugcgugucaagga

SEQ ID NO: 383 - RNA, 19 nt, Artificial
  siRNA construct
ccuggugcgugucaaggag

SEQ ID NO: 384 - RNA, 19 nt, Artificial
  siRNA construct
cuggugcgugucaaggagg

SEQ ID NO: 385 - RNA, 19 nt, Artificial
  siRNA construct
uggugcgugucaaggagga

SEQ ID NO: 386 - RNA, 19 nt, Artificial
  siRNA construct
ggugcgugucaaggaggag

SEQ ID NO: 387 - RNA, 19 nt, Artificial
  siRNA construct
gugcgugucaaggaggagc

SEQ ID NO: 388 - RNA, 19 nt, Artificial
  siRNA construct
ugcgugucaaggaggagcc

SEQ ID NO: 389 - RNA, 19 nt, Artificial
  siRNA construct
gcgugucaaggaggagccc

SEQ ID NO: 390 - RNA, 19 nt, Artificial
  siRNA construct
cccagcccgccucagagcc

SEQ ID NO: 391 - RNA, 19 nt, Artificial
  siRNA construct
ccagcccgccucagagccc

SEQ ID NO: 392 - RNA, 19 nt, Artificial
  siRNA construct
cacuuggaugcuauggacu

SEQ ID NO: 393 - RNA, 19 nt, Artificial
  siRNA construct
acuuggaugcuauggacuc

SEQ ID NO: 394 - RNA, 19 nt, Artificial
  siRNA construct
uuggaugcuauggacucca

SEQ ID NO: 395 - RNA, 19 nt, Artificial
  siRNA construct
uggaugcuauggacuccaa

SEQ ID NO: 396 - RNA, 19 nt, Artificial
  siRNA construct
ggaugcuauggacuccaac

SEQ ID NO: 397 - RNA, 19 nt, Artificial
  siRNA construct
gaugcuauggacuccaacc

SEQ ID NO: 398 - RNA, 19 nt, Artificial
  siRNA construct
augcuauggacuccaaccu

SEQ ID NO: 399 - RNA, 19 nt, Artificial
  siRNA construct
ugcuauggacuccaaccug

SEQ ID NO: 400 - RNA, 19 nt, Artificial
  siRNA construct
gcuauggacuccaaccugg

SEQ ID NO: 401 - RNA, 19 nt, Artificial
  siRNA construct
cuauggacuccaaccugga

SEQ ID NO: 402 - RNA, 19 nt, Artificial
  siRNA construct
aaccugcagaccaugcuga

SEQ ID NO: 403 - RNA, 19 nt, Artificial
  siRNA construct
accugcagaccaugcugag

SEQ ID NO: 404 - RNA, 19 nt, Artificial
  siRNA construct
ccugcagaccaugcugagc

SEQ ID NO: 405 - RNA, 19 nt, Artificial
  siRNA construct
cugcagaccaugcugagca

SEQ ID NO: 406 - RNA, 19 nt, Artificial
  siRNA construct
ugcagaccaugcugagcag

SEQ ID NO: 407 - RNA, 19 nt, Artificial
  siRNA construct
gcagaccaugcugagcagc

SEQ ID NO: 408 - RNA, 19 nt, Artificial
  siRNA construct
cagaccaugcugagcagcc

SEQ ID NO: 409 - RNA, 19 nt, Artificial
  siRNA construct
agaccaugcugagcagcca

SEQ ID NO: 410 - RNA, 19 nt, Artificial
  siRNA construct
gaccaugcugagcagccac

SEQ ID NO: 411 - RNA, 19 nt, Artificial
  siRNA construct
accaugcugagcagccacg

SEQ ID NO: 412 - RNA, 19 nt, Artificial
  siRNA construct
ccaugcugagcagccacgg

SEQ ID NO: 413 - RNA, 19 nt, Artificial
  siRNA construct
caugcugagcagccacggc

SEQ ID NO: 414 - RNA, 19 nt, Artificial
  siRNA construct
augcugagcagccacggcu

SEQ ID NO: 415 - RNA, 19 nt, Artificial
  siRNA construct
ugcugagcagccacggcuu

SEQ ID NO: 416 - RNA, 19 nt, Artificial
  siRNA construct
gcugagcagccacggcuuc

SEQ ID NO: 417 - RNA, 19 nt, Artificial
  siRNA construct
cugagcagccacggcuuca

SEQ ID NO: 418 - RNA, 19 nt, Artificial
  siRNA construct
ugagcagccacggcuucag

SEQ ID NO: 419 - RNA, 19 nt, Artificial
  siRNA construct
gagcagccacggcuucagc

SEQ ID NO: 420 - RNA, 19 nt, Artificial
  siRNA construct
agcagccacggcuucagcg

SEQ ID NO: 421 - RNA, 19 nt, Artificial
  siRNA construct
gcagccacggcuucagcgu

SEQ ID NO: 422 - RNA, 19 nt, Artificial
  siRNA construct
cagccacggcuucagcgug

SEQ ID NO: 423 - RNA, 19 nt, Artificial
  siRNA construct
agccacggcuucagcgugg

SEQ ID NO: 424 - RNA, 19 nt, Artificial
  siRNA construct
gccacggcuucagcgugga

SEQ ID NO: 425 - RNA, 19 nt, Artificial
  siRNA construct
ccacggcuucagcguggac

SEQ ID NO: 426 - RNA, 19 nt, Artificial
  siRNA construct
cacggcuucagcguggaca

SEQ ID NO: 427 - RNA, 19 nt, Artificial
  siRNA construct
acggcuucagcguggacac

SEQ ID NO: 428 - RNA, 19 nt, Artificial
  siRNA construct
cggcuucagcguggacacc

SEQ ID NO: 429 - RNA, 19 nt, Artificial
  siRNA construct
ggcuucagcguggacacca

SEQ ID NO: 430 - RNA, 19 nt, Artificial
  siRNA construct
gcuucagcguggacaccag

SEQ ID NO: 431 - RNA, 19 nt, Artificial
  siRNA construct
gcccugcuggaccuguuca

SEQ ID NO: 432 - RNA, 19 nt, Artificial
  siRNA construct
cccugcuggaccuguucag

SEQ ID NO: 433 - RNA, 19 nt, Artificial
  siRNA construct
ccugcuggaccuguucagc

SEQ ID NO: 434 - RNA, 19 nt, Artificial
  siRNA construct
cugcuggaccuguucagcc

SEQ ID NO: 435 - RNA, 19 nt, Artificial
  siRNA construct
ugcuggaccuguucagccc

SEQ ID NO: 436 - RNA, 19 nt, Artificial
  siRNA construct
cccucggugaccgugcccg

SEQ ID NO: 437 - RNA, 19 nt, Artificial
  siRNA construct
ccucggugaccgugcccga

SEQ ID NO: 438 - RNA, 19 nt, Artificial
  siRNA construct
cucggugaccgugcccgac

SEQ ID NO: 439 - RNA, 19 nt, Artificial
  siRNA construct
ucggugaccgugcccgaca

SEQ ID NO: 440 - RNA, 19 nt, Artificial
  siRNA construct
cggugaccgugcccgacau

SEQ ID NO: 441 - RNA, 19 nt, Artificial
  siRNA construct
ggugaccgugcccgacaug

SEQ ID NO: 442 - RNA, 19 nt, Artificial
  siRNA construct
gugaccgugcccgacauga

SEQ ID NO: 443 - RNA, 19 nt, Artificial
  siRNA construct
ugaccgugcccgacaugag

SEQ ID NO: 444 - RNA, 19 nt, Artificial
  siRNA construct
gaccgugcccgacaugagc

SEQ ID NO: 445 - RNA, 19 nt, Artificial
  siRNA construct
accgugcccgacaugagcc

SEQ ID NO: 446 - RNA, 19 nt, Artificial
  siRNA construct
ccgugcccgacaugagccu

SEQ ID NO: 447 - RNA, 19 nt, Artificial
  siRNA construct
cgugcccgacaugagccug

SEQ ID NO: 448 - RNA, 19 nt, Artificial
  siRNA construct
gugcccgacaugagccugc

SEQ ID NO: 449 - RNA, 19 nt, Artificial
  siRNA construct
ugcccgacaugagccugcc

SEQ ID NO: 450 - RNA, 19 nt, Artificial
  siRNA construct
gcccgacaugagccugccu

SEQ ID NO: 451 - RNA, 19 nt, Artificial
  siRNA construct
cccgacaugagccugccug

SEQ ID NO: 452 - RNA, 19 nt, Artificial
  siRNA construct
ccgacaugagccugccuga

SEQ ID NO: 453 - RNA, 19 nt, Artificial
  siRNA construct
cgacaugagccugccugac

SEQ ID NO: 454 - RNA, 19 nt, Artificial
  siRNA construct
gacaugagccugccugacc

SEQ ID NO: 455 - RNA, 19 nt, Artificial
  siRNA construct
acaugagccugccugaccu

SEQ ID NO: 456 - RNA, 19 nt, Artificial
  siRNA construct
caugagccugccugaccuu

SEQ ID NO: 457 - RNA, 19 nt, Artificial
  siRNA construct
augagccugccugaccuug

SEQ ID NO: 458 - RNA, 19 nt, Artificial
  siRNA construct
ugagccugccugaccuuga

SEQ ID NO: 459 - RNA, 19 nt, Artificial
  siRNA construct
gagccugccugaccuugac

SEQ ID NO: 460 - RNA, 19 nt, Artificial
  siRNA construct
agccugccugaccuugaca

SEQ ID NO: 461 - RNA, 19 nt, Artificial
  siRNA construct
gccugccugaccuugacag

SEQ ID NO: 462 - RNA, 19 nt, Artificial
  siRNA construct
ccugccugaccuugacagc

SEQ ID NO: 463 - RNA, 19 nt, Artificial
  siRNA construct
cugccugaccuugacagca

SEQ ID NO: 464 - RNA, 19 nt, Artificial
  siRNA construct
ugccugaccuugacagcag

SEQ ID NO: 465 - RNA, 19 nt, Artificial
  siRNA construct
gccugaccuugacagcagc

SEQ ID NO: 466 - RNA, 19 nt, Artificial
  siRNA construct
ccugaccuugacagcagcc

SEQ ID NO: 467 - RNA, 19 nt, Artificial
  siRNA construct
cugaccuugacagcagccu

SEQ ID NO: 468 - RNA, 19 nt, Artificial
  siRNA construct
ugaccuugacagcagccug

SEQ ID NO: 469 - RNA, 19 nt, Artificial
  siRNA construct
gaccuugacagcagccugg

SEQ ID NO: 470 - RNA, 19 nt, Artificial
  siRNA construct
accuugacagcagccuggc

SEQ ID NO: 471 - RNA, 19 nt, Artificial
  siRNA construct
aguauccaagagcuccugu

SEQ ID NO: 472 - RNA, 19 nt, Artificial
  siRNA construct
guauccaagagcuccuguc

SEQ ID NO: 473 - RNA, 19 nt, Artificial
  siRNA construct
uauccaagagcuccugucu

SEQ ID NO: 474 - RNA, 19 nt, Artificial
  siRNA construct
auccaagagcuccugucuc

SEQ ID NO: 475 - RNA, 19 nt, Artificial
  siRNA construct
uccaagagcuccugucucc

SEQ ID NO: 476 - RNA, 19 nt, Artificial
  siRNA construct
ccaagagcuccugucuccc

SEQ ID NO: 477 - RNA, 19 nt, Artificial
  siRNA construct
gagaacagcagcccggauu

SEQ ID NO: 478 - RNA, 19 nt, Artificial
  siRNA construct
agaacagcagcccggauuc

SEQ ID NO: 479 - RNA, 19 nt, Artificial
  siRNA construct
gaacagcagcccggauuca

SEQ ID NO: 480 - RNA, 19 nt, Artificial
  siRNA construct
aacagcagcccggauucag

SEQ ID NO: 481 - RNA, 19 nt, Artificial
  siRNA construct
acagcagcccggauucagg

SEQ ID NO: 482 - RNA, 19 nt, Artificial
  siRNA construct
cagcagcccggauucaggg

SEQ ID NO: 483 - RNA, 19 nt, Artificial
  siRNA construct
agcagcccggauucaggga

SEQ ID NO: 484 - RNA, 19 nt, Artificial
  siRNA construct
gcagcccggauucagggaa

SEQ ID NO: 485 - RNA, 19 nt, Artificial
  siRNA construct
cagcccggauucagggaag

SEQ ID NO: 486 - RNA, 19 nt, Artificial
  siRNA construct
agcccggauucagggaagc

SEQ ID NO: 487 - RNA, 19 nt, Artificial
  siRNA construct
gcccggauucagggaagca

SEQ ID NO: 488 - RNA, 19 nt, Artificial
  siRNA construct
cccggauucagggaagcag

SEQ ID NO: 489 - RNA, 19 nt, Artificial
  siRNA construct
ccggauucagggaagcagc

SEQ ID NO: 490 - RNA, 19 nt, Artificial
  siRNA construct
cggauucagggaagcagcu

SEQ ID NO: 491 - RNA, 19 nt, Artificial
  siRNA construct
ggauucagggaagcagcug

SEQ ID NO: 492 - RNA, 19 nt, Artificial
  siRNA construct
gauucagggaagcagcugg

SEQ ID NO: 493 - RNA, 19 nt, Artificial
  siRNA construct
auucagggaagcagcuggu

SEQ ID NO: 494 - RNA, 19 nt, Artificial
  siRNA construct
cccggcuccguggacaccg

SEQ ID NO: 495 - RNA, 19 nt, Artificial
  siRNA construct
ccggcuccguggacaccgg

SEQ ID NO: 496 - RNA, 19 nt, Artificial
  siRNA construct
cggcuccguggacaccggg

SEQ ID NO: 497 - RNA, 19 nt, Artificial
  siRNA construct
ggcuccguggacaccggga

SEQ ID NO: 498 - RNA, 19 nt, Artificial
  siRNA construct
gcuccguggacaccgggag

SEQ ID NO: 499 - RNA, 19 nt, Artificial
  siRNA construct
cuccguggacaccgggagc

SEQ ID NO: 500 - RNA, 19 nt, Artificial
  siRNA construct
uccguggacaccgggagca

SEQ ID NO: 501 - RNA, 19 nt, Artificial
  siRNA construct
ugccggugcuguuugagcu

SEQ ID NO: 502 - RNA, 19 nt, Artificial
  siRNA construct
gccggugcuguuugagcug

SEQ ID NO: 503 - RNA, 19 nt, Artificial
  siRNA construct
ccggugcuguuugagcugg

SEQ ID NO: 504 - RNA, 19 nt, Artificial
  siRNA construct
cggugcuguuugagcuggg

SEQ ID NO: 505 - RNA, 19 nt, Artificial
  siRNA construct
cccaccaucucccugcuga

SEQ ID NO: 506 - RNA, 19 nt, Artificial
  siRNA construct
ccaccaucucccugcugac

SEQ ID NO: 507 - RNA, 19 nt, Artificial
  siRNA construct
caccaucucccugcugaca

SEQ ID NO: 508 - RNA, 19 nt, Artificial
  siRNA construct
gagccucccaaagccaagg

SEQ ID NO: 509 - RNA, 19 nt, Artificial
  siRNA construct
agccucccaaagccaagga

SEQ ID NO: 510 - RNA, 19 nt, Artificial
  siRNA construct
gccucccaaagccaaggac

SEQ ID NO: 511 - RNA, 19 nt, Artificial
  siRNA construct
ccucccaaagccaaggacc

SEQ ID NO: 512 - RNA, 19 nt, Artificial
  siRNA construct
cucccaaagccaaggaccc

SEQ ID NO: 513 - RNA, 19 nt, Artificial
  siRNA construct
ccgggacguugcugggccc

SEQ ID NO: 514 - RNA, 19 nt, Artificial
  siRNA construct
gccgggacguugcugggcc

SEQ ID NO: 515 - RNA, 19 nt, Artificial
  siRNA construct
ggccgggacguugcugggc

SEQ ID NO: 516 - RNA, 19 nt, Artificial
  siRNA construct
aggccgggacguugcuggg

SEQ ID NO: 517 - RNA, 19 nt, Artificial
  siRNA construct
aaggccgggacguugcugg

SEQ ID NO: 518 - RNA, 19 nt, Artificial
  siRNA construct
gaaggccgggacguugcug

SEQ ID NO: 519 - RNA, 19 nt, Artificial
  siRNA construct
ggaaggccgggacguugcu

SEQ ID NO: 520 - RNA, 19 nt, Artificial
  siRNA construct
aggaaggccgggacguugc

SEQ ID NO: 521 - RNA, 19 nt, Artificial
  siRNA construct
caggaaggccgggacguug

SEQ ID NO: 522 - RNA, 19 nt, Artificial
  siRNA construct
ucaggaaggccgggacguu

SEQ ID NO: 523 - RNA, 19 nt, Artificial
  siRNA construct
gucaggaaggccgggacgu

SEQ ID NO: 524 - RNA, 19 nt, Artificial
  siRNA construct
ggucaggaaggccgggacg

SEQ ID NO: 525 - RNA, 19 nt, Artificial
  siRNA construct
uggucaggaaggccgggac

SEQ ID NO: 526 - RNA, 19 nt, Artificial
  siRNA construct
gcuuggucaggaaggccgg

SEQ ID NO: 527 - RNA, 19 nt, Artificial
  siRNA construct
agcuuggucaggaaggccg

SEQ ID NO: 528 - RNA, 19 nt, Artificial
  siRNA construct
cagcuuggucaggaaggcc

SEQ ID NO: 529 - RNA, 19 nt, Artificial
  siRNA construct
acagcuuggucaggaaggc

SEQ ID NO: 530 - RNA, 19 nt, Artificial
  siRNA construct
cacagcuuggucaggaagg

SEQ ID NO: 531 - RNA, 19 nt, Artificial
  siRNA construct
ccacagcuuggucaggaag

SEQ ID NO: 532 - RNA, 19 nt, Artificial
  siRNA construct
uccacagcuuggucaggaa

SEQ ID NO: 533 - RNA, 19 nt, Artificial
  siRNA construct
guccacagcuuggucagga

SEQ ID NO: 534 - RNA, 19 nt, Artificial
  siRNA construct
gguccacagcuuggucagg

SEQ ID NO: 535 - RNA, 19 nt, Artificial
  siRNA construct
ggguccacagcuuggucag

SEQ ID NO: 536 - RNA, 19 nt, Artificial
  siRNA construct
aggguccacagcuugguca

SEQ ID NO: 537 - RNA, 19 nt, Artificial
  siRNA construct
gaggguccacagcuugguc

SEQ ID NO: 538 - RNA, 19 nt, Artificial
  siRNA construct
cgaggguccacagcuuggu

SEQ ID NO: 539 - RNA, 19 nt, Artificial
  siRNA construct
acgaggguccacagcuugg

SEQ ID NO: 540 - RNA, 19 nt, Artificial
  siRNA construct
cacgaggguccacagcuug

SEQ ID NO: 541 - RNA, 19 nt, Artificial
  siRNA construct
ucacgaggguccacagcuu

SEQ ID NO: 542 - RNA, 19 nt, Artificial
  siRNA construct
cucacgaggguccacagcu

SEQ ID NO: 543 - RNA, 19 nt, Artificial
  siRNA construct
gcucacgaggguccacagc

SEQ ID NO: 544 - RNA, 19 nt, Artificial
  siRNA construct
cgcucacgaggguccacag

SEQ ID NO: 545 - RNA, 19 nt, Artificial
  siRNA construct
ucgcucacgaggguccaca

SEQ ID NO: 546 - RNA, 19 nt, Artificial
  siRNA construct
gucgcucacgaggguccac

SEQ ID NO: 547 - RNA, 19 nt, Artificial
  siRNA construct
ggucgcucacgagggucca

SEQ ID NO: 548 - RNA, 19 nt, Artificial
  siRNA construct
gggucgcucacgagggucc

SEQ ID NO: 549 - RNA, 19 nt, Artificial
  siRNA construct
cgggucgcucacgaggguc

SEQ ID NO: 550 - RNA, 19 nt, Artificial
  siRNA construct
ccgggucgcucacgagggu

SEQ ID NO: 551 - RNA, 19 nt, Artificial
  siRNA construct
uccgggucgcucacgaggg

SEQ ID NO: 552 - RNA, 19 nt, Artificial
  siRNA construct
guccgggucgcucacgagg

SEQ ID NO: 553 - RNA, 19 nt, Artificial
  siRNA construct
uguccgggucgcucacgag

SEQ ID NO: 554 - RNA, 19 nt, Artificial
  siRNA construct
guguccgggucgcucacga

SEQ ID NO: 555 - RNA, 19 nt, Artificial
  siRNA construct
gguguccgggucgcucacg

SEQ ID NO: 556 - RNA, 19 nt, Artificial
  siRNA construct
cgguguccgggucgcucac

SEQ ID NO: 557 - RNA, 19 nt, Artificial
  siRNA construct
ucgguguccgggucgcuca

SEQ ID NO: 558 - RNA, 19 nt, Artificial
  siRNA construct
gucgguguccgggucgcuc

SEQ ID NO: 559 - RNA, 19 nt, Artificial
  siRNA construct
cgucgguguccgggucgcu

SEQ ID NO: 560 - RNA, 19 nt, Artificial
  siRNA construct
gcgucgguguccgggucgc

SEQ ID NO: 561 - RNA, 19 nt, Artificial
  siRNA construct
ucgggcuccagcagaugag

SEQ ID NO: 562 - RNA, 19 nt, Artificial
  siRNA construct
cucgggcuccagcagauga

SEQ ID NO: 563 - RNA, 19 nt, Artificial
  siRNA construct
acuggcccuggucgaacac

SEQ ID NO: 564 - RNA, 19 nt, Artificial
  siRNA construct
aacuggcccuggucgaaca

SEQ ID NO: 565 - RNA, 19 nt, Artificial
  siRNA construct
aaacuggcccuggucgaac

SEQ ID NO: 566 - RNA, 19 nt, Artificial
  siRNA construct
caaacuggcccuggucgaa

SEQ ID NO: 567 - RNA, 19 nt, Artificial
  siRNA construct
gcaaacuggcccuggucga

SEQ ID NO: 568 - RNA, 19 nt, Artificial
  siRNA construct
ggcaaacuggcccuggucg

SEQ ID NO: 569 - RNA, 19 nt, Artificial
  siRNA construct
uggcaaacuggcccugguc

SEQ ID NO: 570 - RNA, 19 nt, Artificial
  siRNA construct
uuggcaaacuggcccuggu

SEQ ID NO: 571 - RNA, 19 nt, Artificial
  siRNA construct
cuuggcaaacuggcccugg

SEQ ID NO: 572 - RNA, 19 nt, Artificial
  siRNA construct
ccuuggcaaacuggcccug

SEQ ID NO: 573 - RNA, 19 nt, Artificial
  siRNA construct
uccuuggcaaacuggcccu

SEQ ID NO: 574 - RNA, 19 nt, Artificial
  siRNA construct
cuccuuggcaaacuggccc

SEQ ID NO: 575 - RNA, 19 nt, Artificial
  siRNA construct
ccuccuuggcaaacuggcc

SEQ ID NO: 576 - RNA, 19 nt, Artificial
  siRNA construct
accuccuuggcaaacuggc

SEQ ID NO: 577 - RNA, 19 nt, Artificial
  siRNA construct
caccuccuuggcaaacugg

SEQ ID NO: 578 - RNA, 19 nt, Artificial
  siRNA construct
gcaccuccuuggcaaacug

SEQ ID NO: 579 - RNA, 19 nt, Artificial
  siRNA construct
agcaccuccuuggcaaacu

SEQ ID NO: 580 - RNA, 19 nt, Artificial
  siRNA construct
cagcaccuccuuggcaaac

SEQ ID NO: 581 - RNA, 19 nt, Artificial
  siRNA construct
gcagcaccuccuuggcaaa

SEQ ID NO: 582 - RNA, 19 nt, Artificial
  siRNA construct
ggcagcaccuccuuggcaa

SEQ ID NO: 583 - RNA, 19 nt, Artificial
  siRNA construct
gggcagcaccuccuuggca

SEQ ID NO: 584 - RNA, 19 nt, Artificial
  siRNA construct
ugggcagcaccuccuuggc

SEQ ID NO: 585 - RNA, 19 nt, Artificial
  siRNA construct
uugggcagcaccuccuugg

SEQ ID NO: 586 - RNA, 19 nt, Artificial
  siRNA construct
cuugggcagcaccuccuug

SEQ ID NO: 587 - RNA, 19 nt, Artificial
  siRNA construct
acuugggcagcaccuccuu

SEQ ID NO: 588 - RNA, 19 nt, Artificial
  siRNA construct
uacuugggcagcaccuccu

SEQ ID NO: 589 - RNA, 19 nt, Artificial
  siRNA construct
ccauguuguugugcuugaa

SEQ ID NO: 590 - RNA, 19 nt, Artificial
  siRNA construct
gccauguuguugugcuuga

SEQ ID NO: 591 - RNA, 19 nt, Artificial
  siRNA construct
ggccauguuguugugcuug

SEQ ID NO: 592 - RNA, 19 nt, Artificial
  siRNA construct
uggccauguuguugugcuu

SEQ ID NO: 593 - RNA, 19 nt, Artificial
  siRNA construct
cuggccauguuguugugcu

SEQ ID NO: 594 - RNA, 19 nt, Artificial
  siRNA construct
gcuggccauguuguugugc

SEQ ID NO: 595 - RNA, 19 nt, Artificial
  siRNA construct
agcuggccauguuguugug

SEQ ID NO: 596 - RNA, 19 nt, Artificial
  siRNA construct
aagcuggccauguuguugu

SEQ ID NO: 597 - RNA, 19 nt, Artificial
  siRNA construct
cgaagcuggccauguuguu

SEQ ID NO: 598 - RNA, 19 nt, Artificial
  siRNA construct
acgaagcuggccauguugu

SEQ ID NO: 599 - RNA, 19 nt, Artificial
  siRNA construct
cacgaagcuggccauguug

SEQ ID NO: 600 - RNA, 19 nt, Artificial
  siRNA construct
gcacgaagcuggccauguu

SEQ ID NO: 601 - RNA, 19 nt, Artificial
  siRNA construct
cgcacgaagcuggccaugu

SEQ ID NO: 602 - RNA, 19 nt, Artificial
  siRNA construct
ccgcacgaagcuggccaug

SEQ ID NO: 603 - RNA, 19 nt, Artificial
  siRNA construct
gccgcacgaagcuggccau

SEQ ID NO: 604 - RNA, 19 nt, Artificial
  siRNA construct
ugccgcacgaagcuggcca

SEQ ID NO: 605 - RNA, 19 nt, Artificial
  siRNA construct
ucucucucuggcuugacca

SEQ ID NO: 606 - RNA, 19 nt, Artificial
  siRNA construct
gucucucucuggcuugacc

SEQ ID NO: 607 - RNA, 19 nt, Artificial
  siRNA construct
cgucucucucuggcuugac

SEQ ID NO: 608 - RNA, 19 nt, Artificial
  siRNA construct
ucgucucucucuggcuuga

SEQ ID NO: 609 - RNA, 19 nt, Artificial
  siRNA construct
gucgucucucucuggcuug

SEQ ID NO: 610 - RNA, 19 nt, Artificial
  siRNA construct
ugucgucucucucuggcuu

SEQ ID NO: 611 - RNA, 19 nt, Artificial
  siRNA construct
gugucgucucucucuggcu

SEQ ID NO: 612 - RNA, 19 nt, Artificial
  siRNA construct
cgugucgucucucucuggc

SEQ ID NO: 613 - RNA, 19 nt, Artificial
  siRNA construct
ccgugucgucucucucugg

SEQ ID NO: 614 - RNA, 19 nt, Artificial
  siRNA construct
uccgugucgucucucucug

SEQ ID NO: 615 - RNA, 19 nt, Artificial
  siRNA construct
cuccgugucgucucucucu

SEQ ID NO: 616 - RNA, 19 nt, Artificial
  siRNA construct
acuccgugucgucucucuc

SEQ ID NO: 617 - RNA, 19 nt, Artificial
  siRNA construct
aacuccgugucgucucucu

SEQ ID NO: 618 - RNA, 19 nt, Artificial
  siRNA construct
gaacuccgugucgucucuc

SEQ ID NO: 619 - RNA, 19 nt, Artificial
  siRNA construct
ggaacuccgugucgucucu

SEQ ID NO: 620 - RNA, 19 nt, Artificial
  siRNA construct
uggaacuccgugucgucuc

SEQ ID NO: 621 - RNA, 19 nt, Artificial
  siRNA construct
cuggaacuccgugucgucu

SEQ ID NO: 622 - RNA, 19 nt, Artificial
  siRNA construct
gcuggaacuccgugucguc

SEQ ID NO: 623 - RNA, 19 nt, Artificial
  siRNA construct
ugcuggaacuccgugucgu

SEQ ID NO: 624 - RNA, 19 nt, Artificial
  siRNA construct
gugcuggaacuccgugucg

SEQ ID NO: 625 - RNA, 19 nt, Artificial
  siRNA construct
ggugcuggaacuccguguc

SEQ ID NO: 626 - RNA, 19 nt, Artificial
  siRNA construct
gggugcuggaacuccgugu

SEQ ID NO: 627 - RNA, 19 nt, Artificial
  siRNA construct
caaggagcugcuccuggcc

SEQ ID NO: 628 - RNA, 19 nt, Artificial
  siRNA construct
ucaaggagcugcuccuggc

SEQ ID NO: 629 - RNA, 19 nt, Artificial
  siRNA construct
cucaaggagcugcuccugg

SEQ ID NO: 630 - RNA, 19 nt, Artificial
  siRNA construct
ucucaaggagcugcuccug

SEQ ID NO: 631 - RNA, 19 nt, Artificial
  siRNA construct
uucucaaggagcugcuccu

SEQ ID NO: 632 - RNA, 19 nt, Artificial
  siRNA construct
guucucaaggagcugcucc

SEQ ID NO: 633 - RNA, 19 nt, Artificial
  siRNA construct
uguucucaaggagcugcuc

SEQ ID NO: 634 - RNA, 19 nt, Artificial
  siRNA construct
auguucucaaggagcugcu

SEQ ID NO: 635 - RNA, 19 nt, Artificial
  siRNA construct
gauguucucaaggagcugc

SEQ ID NO: 636 - RNA, 19 nt, Artificial
  siRNA construct
ugauguucucaaggagcug

SEQ ID NO: 637 - RNA, 19 nt, Artificial
  siRNA construct
uugauguucucaaggagcu

SEQ ID NO: 638 - RNA, 19 nt, Artificial
  siRNA construct
cuugauguucucaaggagc

SEQ ID NO: 639 - RNA, 19 nt, Artificial
  siRNA construct
ucuugauguucucaaggag

SEQ ID NO: 640 - RNA, 19 nt, Artificial
  siRNA construct
cucuugauguucucaagga

SEQ ID NO: 641 - RNA, 19 nt, Artificial
  siRNA construct
ccucuugauguucucaagg

SEQ ID NO: 642 - RNA, 19 nt, Artificial
  siRNA construct
uccucuugauguucucaag

SEQ ID NO: 643 - RNA, 19 nt, Artificial
  siRNA construct
uuccucuugauguucucaa

SEQ ID NO: 644 - RNA, 19 nt, Artificial
  siRNA construct
uuuccucuugauguucuca

SEQ ID NO: 645 - RNA, 19 nt, Artificial
  siRNA construct
cuuuccucuugauguucuc

SEQ ID NO: 646 - RNA, 19 nt, Artificial
  siRNA construct
acuuuccucuugauguucu

SEQ ID NO: 647 - RNA, 19 nt, Artificial
  siRNA construct
cacuuuccucuugauguuc

SEQ ID NO: 648 - RNA, 19 nt, Artificial
  siRNA construct
ucacuuuccucuugauguu

SEQ ID NO: 649 - RNA, 19 nt, Artificial
  siRNA construct
gucacuuuccucuugaugu

SEQ ID NO: 650 - RNA, 19 nt, Artificial
  siRNA construct
ggucacuuuccucuugaug

SEQ ID NO: 651 - RNA, 19 nt, Artificial
  siRNA construct
uggucacuuuccucuugau

SEQ ID NO: 652 - RNA, 19 nt, Artificial
  siRNA construct
cuggucacuuuccucuuga

SEQ ID NO: 653 - RNA, 19 nt, Artificial
  siRNA construct
acuggucacuuuccucuug

SEQ ID NO: 654 - RNA, 19 nt, Artificial
  siRNA construct
cacuggucacuuuccucuu

SEQ ID NO: 655 - RNA, 19 nt, Artificial
  siRNA construct
cacacuggucacuuuccuc

SEQ ID NO: 656 - RNA, 19 nt, Artificial
  siRNA construct
acacacuggucacuuuccu

SEQ ID NO: 657 - RNA, 19 nt, Artificial
  siRNA construct
gacacacuggucacuuucc

SEQ ID NO: 658 - RNA, 19 nt, Artificial
  siRNA construct
ggacacacuggucacuuuc

SEQ ID NO: 659 - RNA, 19 nt, Artificial
  siRNA construct
uggacacacuggucacuuu

SEQ ID NO: 660 - RNA, 19 nt, Artificial
  siRNA construct
guggacacacuggucacuu

SEQ ID NO: 661 - RNA, 19 nt, Artificial
  siRNA construct
gguggacacacuggucacu

SEQ ID NO: 662 - RNA, 19 nt, Artificial
  siRNA construct
ggguggacacacuggucac

SEQ ID NO: 663 - RNA, 19 nt, Artificial
  siRNA construct
aggguggacacacugguca

SEQ ID NO: 664 - RNA, 19 nt, Artificial
  siRNA construct
caggguggacacacugguc

SEQ ID NO: 665 - RNA, 19 nt, Artificial
  siRNA construct
ucaggguggacacacuggu

SEQ ID NO: 666 - RNA, 19 nt, Artificial
  siRNA construct
uucaggguggacacacugg

SEQ ID NO: 667 - RNA, 19 nt, Artificial
  siRNA construct
cuucaggguggacacacug

SEQ ID NO: 668 - RNA, 19 nt, Artificial
  siRNA construct
ucuucaggguggacacacu

SEQ ID NO: 669 - RNA, 19 nt, Artificial
  siRNA construct
cucuucaggguggacacac

SEQ ID NO: 670 - RNA, 19 nt, Artificial
  siRNA construct
acucuucaggguggacaca

SEQ ID NO: 671 - RNA, 19 nt, Artificial
  siRNA construct
cacucuucaggguggacac

SEQ ID NO: 672 - RNA, 19 nt, Artificial
  siRNA construct
ucacucuucaggguggaca

SEQ ID NO: 673 - RNA, 19 nt, Artificial
  siRNA construct
uucacucuucaggguggac

SEQ ID NO: 674 - RNA, 19 nt, Artificial
  siRNA construct
cuucacucuucagggugga

SEQ ID NO: 675 - RNA, 19 nt, Artificial
  siRNA construct
ucuucacucuucagggugg

SEQ ID NO: 676 - RNA, 19 nt, Artificial
  siRNA construct
gucuucacucuucagggug

SEQ ID NO: 677 - RNA, 19 nt, Artificial
  siRNA construct
ugucuucacucuucagggu

SEQ ID NO: 678 - RNA, 19 nt, Artificial
  siRNA construct
augucuucacucuucaggg

SEQ ID NO: 679 - RNA, 19 nt, Artificial
  siRNA construct
uaugucuucacucuucagg

SEQ ID NO: 680 - RNA, 19 nt, Artificial
  siRNA construct
uuaugucuucacucuucag

SEQ ID NO: 681 - RNA, 19 nt, Artificial
  siRNA construct
uuuaugucuucacucuuca

SEQ ID NO: 682 - RNA, 19 nt, Artificial
  siRNA construct
cuuuaugucuucacucuuc

SEQ ID NO: 683 - RNA, 19 nt, Artificial
  siRNA construct
ucuuuaugucuucacucuu

SEQ ID NO: 684 - RNA, 19 nt, Artificial
  siRNA construct
aucuuuaugucuucacucu

SEQ ID NO: 685 - RNA, 19 nt, Artificial
  siRNA construct
gaucuuuaugucuucacuc

SEQ ID NO: 686 - RNA, 19 nt, Artificial
  siRNA construct
ggaucuuuaugucuucacu

SEQ ID NO: 687 - RNA, 19 nt, Artificial
  siRNA construct
cggaucuuuaugucuucac

SEQ ID NO: 688 - RNA, 19 nt, Artificial
  siRNA construct
ccgucagcagcuuggugac

SEQ ID NO: 689 - RNA, 19 nt, Artificial
  siRNA construct
uccgucagcagcuugguga

SEQ ID NO: 690 - RNA, 19 nt, Artificial
  siRNA construct
guccgucagcagcuuggug

SEQ ID NO: 691 - RNA, 19 nt, Artificial
  siRNA construct
cguccgucagcagcuuggu

SEQ ID NO: 692 - RNA, 19 nt, Artificial
  siRNA construct
acguccgucagcagcuugg

SEQ ID NO: 693 - RNA, 19 nt, Artificial
  siRNA construct
cacguccgucagcagcuug

SEQ ID NO: 694 - RNA, 19 nt, Artificial
  siRNA construct
gcacguccgucagcagcuu

SEQ ID NO: 695 - RNA, 19 nt, Artificial
  siRNA construct
ugcacguccgucagcagcu

SEQ ID NO: 696 - RNA, 19 nt, Artificial
  siRNA construct
cugcacguccgucagcagc

SEQ ID NO: 697 - RNA, 19 nt, Artificial
  siRNA construct
gcugcacguccgucagcag

SEQ ID NO: 698 - RNA, 19 nt, Artificial
  siRNA construct
agcugcacguccgucagca

SEQ ID NO: 699 - RNA, 19 nt, Artificial
  siRNA construct
cagcugcacguccgucagc

SEQ ID NO: 700 - RNA, 19 nt, Artificial
  siRNA construct
ucagcugcacguccgucag

SEQ ID NO: 701 - RNA, 19 nt, Artificial
  siRNA construct
aucagcugcacguccguca

SEQ ID NO: 702 - RNA, 19 nt, Artificial
  siRNA construct
caucagcugcacguccguc

SEQ ID NO: 703 - RNA, 19 nt, Artificial
  siRNA construct
ucaucagcugcacguccgu

SEQ ID NO: 704 - RNA, 19 nt, Artificial
  siRNA construct
uucaucagcugcacguccg

SEQ ID NO: 705 - RNA, 19 nt, Artificial
  siRNA construct
cuucaucagcugcacgucc

SEQ ID NO: 706 - RNA, 19 nt, Artificial
  siRNA construct
ccuucaucagcugcacguc

SEQ ID NO: 707 - RNA, 19 nt, Artificial
  siRNA construct
cccuucaucagcugcacgu

SEQ ID NO: 708 - RNA, 19 nt, Artificial
  siRNA construct
gccacagagccucauucuc

SEQ ID NO: 709 - RNA, 19 nt, Artificial
  siRNA construct
cgccacagagccucauucu

SEQ ID NO: 710 - RNA, 19 nt, Artificial
  siRNA construct
ccgccacagagccucauuc

SEQ ID NO: 711 - RNA, 19 nt, Artificial
  siRNA construct
cccgccacagagccucauu

SEQ ID NO: 712 - RNA, 19 nt, Artificial
  siRNA construct
ucccgccacagagccucau

SEQ ID NO: 713 - RNA, 19 nt, Artificial
  siRNA construct
cucccgccacagagccuca

SEQ ID NO: 714 - RNA, 19 nt, Artificial
  siRNA construct
ccucccgccacagagccuc

SEQ ID NO: 715 - RNA, 19 nt, Artificial
  siRNA construct
accucccgccacagagccu

SEQ ID NO: 716 - RNA, 19 nt, Artificial
  siRNA construct
caccucccgccacagagcc

SEQ ID NO: 717 - RNA, 19 nt, Artificial
  siRNA construct
ccaccucccgccacagagc

SEQ ID NO: 718 - RNA, 19 nt, Artificial
  siRNA construct
gccaccucccgccacagag

SEQ ID NO: 719 - RNA, 19 nt, Artificial
  siRNA construct
ggccaccucccgccacaga

SEQ ID NO: 720 - RNA, 19 nt, Artificial
  siRNA construct
uggccaccucccgccacag

SEQ ID NO: 721 - RNA, 19 nt, Artificial
  siRNA construct
cuggccaccucccgccaca

SEQ ID NO: 722 - RNA, 19 nt, Artificial
  siRNA construct
gcuggccaccucccgccac

SEQ ID NO: 723 - RNA, 19 nt, Artificial
  siRNA construct
ggcuggccaccucccgcca

SEQ ID NO: 724 - RNA, 19 nt, Artificial
  siRNA construct
aggcuggccaccucccgcc

SEQ ID NO: 725 - RNA, 19 nt, Artificial
  siRNA construct
aaggcuggccaccucccgc

SEQ ID NO: 726 - RNA, 19 nt, Artificial
  siRNA construct
gaaggcuggccaccucccg

SEQ ID NO: 727 - RNA, 19 nt, Artificial
  siRNA construct
cgaaggcuggccaccuccc

SEQ ID NO: 728 - RNA, 19 nt, Artificial
  siRNA construct
ccgaaggcuggccaccucc

SEQ ID NO: 729 - RNA, 19 nt, Artificial
  siRNA construct
gccgaaggcuggccaccuc

SEQ ID NO: 730 - RNA, 19 nt, Artificial
  siRNA construct
ugccgaaggcuggccaccu

SEQ ID NO: 731 - RNA, 19 nt, Artificial
  siRNA construct
cugccgaaggcuggccacc

SEQ ID NO: 732 - RNA, 19 nt, Artificial
  siRNA construct
ucugccgaaggcuggccac

SEQ ID NO: 733 - RNA, 19 nt, Artificial
  siRNA construct
uucugccgaaggcuggcca

SEQ ID NO: 734 - RNA, 19 nt, Artificial
  siRNA construct
cuucugccgaaggcuggcc

SEQ ID NO: 735 - RNA, 19 nt, Artificial
  siRNA construct
gcuucugccgaaggcuggc

SEQ ID NO: 736 - RNA, 19 nt, Artificial
  siRNA construct
ugcuucugccgaaggcugg

SEQ ID NO: 737 - RNA, 19 nt, Artificial
  siRNA construct
augcuucugccgaaggcug

SEQ ID NO: 738 - RNA, 19 nt, Artificial
  siRNA construct
caugcuucugccgaaggcu

SEQ ID NO: 739 - RNA, 19 nt, Artificial
  siRNA construct
gcaugcuucugccgaaggc

SEQ ID NO: 740 - RNA, 19 nt, Artificial
  siRNA construct
ggcaugcuucugccgaagg

SEQ ID NO: 741 - RNA, 19 nt, Artificial
  siRNA construct
gggcaugcuucugccgaag

SEQ ID NO: 742 - RNA, 19 nt, Artificial
  siRNA construct
ugggcaugcuucugccgaa

SEQ ID NO: 743 - RNA, 19 nt, Artificial
  siRNA construct
cugggcaugcuucugccga

SEQ ID NO: 744 - RNA, 19 nt, Artificial
  siRNA construct
gcugggcaugcuucugccg

SEQ ID NO: 745 - RNA, 19 nt, Artificial
  siRNA construct
ugcugggcaugcuucugcc

SEQ ID NO: 746 - RNA, 19 nt, Artificial
  siRNA construct
uugcugggcaugcuucugc

SEQ ID NO: 747 - RNA, 19 nt, Artificial
  siRNA construct
guugcugggcaugcuucug

SEQ ID NO: 748 - RNA, 19 nt, Artificial
  siRNA construct
uguugcugggcaugcuucu

SEQ ID NO: 749 - RNA, 19 nt, Artificial
  siRNA construct
cuguugcugggcaugcuuc

SEQ ID NO: 750 - RNA, 19 nt, Artificial
  siRNA construct
ucuguugcugggcaugcuu

SEQ ID NO: 751 - RNA, 19 nt, Artificial
  siRNA construct
uucuguugcugggcaugcu

SEQ ID NO: 752 - RNA, 19 nt, Artificial
  siRNA construct
uuucuguugcugggcaugc

SEQ ID NO: 753 - RNA, 19 nt, Artificial
  siRNA construct
cuuucuguugcugggcaug

SEQ ID NO: 754 - RNA, 19 nt, Artificial
  siRNA construct
acuuucuguugcugggcau

SEQ ID NO: 755 - RNA, 19 nt, Artificial
  siRNA construct
gacuuucuguugcugggca

SEQ ID NO: 756 - RNA, 19 nt, Artificial
  siRNA construct
cgacuuucuguugcugggc

SEQ ID NO: 757 - RNA, 19 nt, Artificial
  siRNA construct
acgacuuucuguugcuggg

SEQ ID NO: 758 - RNA, 19 nt, Artificial
  siRNA construct
gacgacuuucuguugcugg

SEQ ID NO: 759 - RNA, 19 nt, Artificial
  siRNA construct
ugacgacuuucuguugcug

SEQ ID NO: 760 - RNA, 19 nt, Artificial
  siRNA construct
uugacgacuuucuguugcu

SEQ ID NO: 761 - RNA, 19 nt, Artificial
  siRNA construct
guugacgacuuucuguugc

SEQ ID NO: 762 - RNA, 19 nt, Artificial
  siRNA construct
uguugacgacuuucuguug

SEQ ID NO: 763 - RNA, 19 nt, Artificial
  siRNA construct
uuguugacgacuuucuguu

SEQ ID NO: 764 - RNA, 19 nt, Artificial
  siRNA construct
cuuguugacgacuuucugu

SEQ ID NO: 765 - RNA, 19 nt, Artificial
  siRNA construct
gcuuguugacgacuuucug

SEQ ID NO: 766 - RNA, 19 nt, Artificial
  siRNA construct
agcuuguugacgacuuucu

SEQ ID NO: 767 - RNA, 19 nt, Artificial
  siRNA construct
gagcuuguugacgacuuuc

SEQ ID NO: 768 - RNA, 19 nt, Artificial
  siRNA construct
ugagcuuguugacgacuuu

SEQ ID NO: 769 - RNA, 19 nt, Artificial
  siRNA construct
augagcuuguugacgacuu

SEQ ID NO: 770 - RNA, 19 nt, Artificial
  siRNA construct
aaugagcuuguugacgacu

SEQ ID NO: 771 - RNA, 19 nt, Artificial
  siRNA construct
gaaugagcuuguugacgac

SEQ ID NO: 772 - RNA, 19 nt, Artificial
  siRNA construct
ugaaugagcuuguugacga

SEQ ID NO: 773 - RNA, 19 nt, Artificial
  siRNA construct
cugaaugagcuuguugacg

SEQ ID NO: 774 - RNA, 19 nt, Artificial
  siRNA construct
acugaaugagcuuguugac

SEQ ID NO: 775 - RNA, 19 nt, Artificial
  siRNA construct
aacugaaugagcuuguuga

SEQ ID NO: 776 - RNA, 19 nt, Artificial
  siRNA construct
gaacugaaugagcuuguug

SEQ ID NO: 777 - RNA, 19 nt, Artificial
  siRNA construct
ggaacugaaugagcuuguu

SEQ ID NO: 778 - RNA, 19 nt, Artificial
  siRNA construct
aggaacugaaugagcuugu

SEQ ID NO: 779 - RNA, 19 nt, Artificial
  siRNA construct
caggaacugaaugagcuug

SEQ ID NO: 780 - RNA, 19 nt, Artificial
  siRNA construct
ucaggaacugaaugagcuu

SEQ ID NO: 781 - RNA, 19 nt, Artificial
  siRNA construct
aucaggaacugaaugagcu

SEQ ID NO: 782 - RNA, 19 nt, Artificial
  siRNA construct
gaucaggaacugaaugagc

SEQ ID NO: 783 - RNA, 19 nt, Artificial
  siRNA construct
agaucaggaacugaaugag

SEQ ID NO: 784 - RNA, 19 nt, Artificial
  siRNA construct
gagaucaggaacugaauga

SEQ ID NO: 785 - RNA, 19 nt, Artificial
  siRNA construct
ugagaucaggaacugaaug

SEQ ID NO: 786 - RNA, 19 nt, Artificial
  siRNA construct
gugagaucaggaacugaau

SEQ ID NO: 787 - RNA, 19 nt, Artificial
  siRNA construct
agugagaucaggaacugaa

SEQ ID NO: 788 - RNA, 19 nt, Artificial
  siRNA construct
cagugagaucaggaacuga

SEQ ID NO: 789 - RNA, 19 nt, Artificial
  siRNA construct
ccagugagaucaggaacug

SEQ ID NO: 790 - RNA, 19 nt, Artificial
  siRNA construct
accagugagaucaggaacu

SEQ ID NO: 791 - RNA, 19 nt, Artificial
  siRNA construct
gcaccagugagaucaggaa

SEQ ID NO: 792 - RNA, 19 nt, Artificial
  siRNA construct
ugcaccagugagaucagga

SEQ ID NO: 793 - RNA, 19 nt, Artificial
  siRNA construct
cugcaccagugagaucagg

SEQ ID NO: 794 - RNA, 19 nt, Artificial
  siRNA construct
gacugcaccagugagauca

SEQ ID NO: 795 - RNA, 19 nt, Artificial
  siRNA construct
ugacugcaccagugagauc

SEQ ID NO: 796 - RNA, 19 nt, Artificial
  siRNA construct
uugacugcaccagugagau

SEQ ID NO: 797 - RNA, 19 nt, Artificial
  siRNA construct
uuugacugcaccagugaga

SEQ ID NO: 798 - RNA, 19 nt, Artificial
  siRNA construct
guuugacugcaccagugag

SEQ ID NO: 799 - RNA, 19 nt, Artificial
  siRNA construct
cgguuugacugcaccagug

SEQ ID NO: 800 - RNA, 19 nt, Artificial
  siRNA construct
ccgguuugacugcaccagu

SEQ ID NO: 801 - RNA, 19 nt, Artificial
  siRNA construct
uccgguuugacugcaccag

SEQ ID NO: 802 - RNA, 19 nt, Artificial
  siRNA construct
auccgguuugacugcacca

SEQ ID NO: 803 - RNA, 19 nt, Artificial
  siRNA construct
gauccgguuugacugcacc

SEQ ID NO: 804 - RNA, 19 nt, Artificial
  siRNA construct
ggauccgguuugacugcac

SEQ ID NO: 805 - RNA, 19 nt, Artificial
  siRNA construct
aggauccgguuugacugca

SEQ ID NO: 806 - RNA, 19 nt, Artificial
  siRNA construct
caggauccgguuugacugc

SEQ ID NO: 807 - RNA, 19 nt, Artificial
  siRNA construct
ccaggauccgguuugacug

SEQ ID NO: 808 - RNA, 19 nt, Artificial
  siRNA construct
cccaggauccgguuugacu

SEQ ID NO: 809 - RNA, 19 nt, Artificial
  siRNA construct
gggaucuuucucuucaccc

SEQ ID NO: 810 - RNA, 19 nt, Artificial
  siRNA construct
cugucguucagcaucaggg

SEQ ID NO: 811 - RNA, 19 nt, Artificial
  siRNA construct
acugucguucagcaucagg

SEQ ID NO: 812 - RNA, 19 nt, Artificial
  siRNA construct
cacugucguucagcaucag

SEQ ID NO: 813 - RNA, 19 nt, Artificial
  siRNA construct
ccacugucguucagcauca

SEQ ID NO: 814 - RNA, 19 nt, Artificial
  siRNA construct
gccacugucguucagcauc

SEQ ID NO: 815 - RNA, 19 nt, Artificial
  siRNA construct
agccacugucguucagcau

SEQ ID NO: 816 - RNA, 19 nt, Artificial
  siRNA construct
gagccacugucguucagca

SEQ ID NO: 817 - RNA, 19 nt, Artificial
  siRNA construct
ugagccacugucguucagc

SEQ ID NO: 818 - RNA, 19 nt, Artificial
  siRNA construct
cugagccacugucguucag

SEQ ID NO: 819 - RNA, 19 nt, Artificial
  siRNA construct
gcugagccacugucguuca

SEQ ID NO: 820 - RNA, 19 nt, Artificial
  siRNA construct
ugcugagccacugucguuc

SEQ ID NO: 821 - RNA, 19 nt, Artificial
  siRNA construct
gugcugagccacugucguu

SEQ ID NO: 822 - RNA, 19 nt, Artificial
  siRNA construct
ugugcugagccacugucgu

SEQ ID NO: 823 - RNA, 19 nt, Artificial
  siRNA construct
augugcugagccacugucg

SEQ ID NO: 824 - RNA, 19 nt, Artificial
  siRNA construct
aaugugcugagccacuguc

SEQ ID NO: 825 - RNA, 19 nt, Artificial
  siRNA construct
gaaugugcugagccacugu

SEQ ID NO: 826 - RNA, 19 nt, Artificial
  siRNA construct
ggaaugugcugagccacug

SEQ ID NO: 827 - RNA, 19 nt, Artificial
  siRNA construct
uggaaugugcugagccacu

SEQ ID NO: 828 - RNA, 19 nt, Artificial
  siRNA construct
auggaaugugcugagccac

SEQ ID NO: 829 - RNA, 19 nt, Artificial
  siRNA construct
cauggaaugugcugagcca

SEQ ID NO: 830 - RNA, 19 nt, Artificial
  siRNA construct
gcauggaaugugcugagcc

SEQ ID NO: 831 - RNA, 19 nt, Artificial
  siRNA construct
ggcauggaaugugcugagc

SEQ ID NO: 832 - RNA, 19 nt, Artificial
  siRNA construct
gggcauggaaugugcugag

SEQ ID NO: 833 - RNA, 19 nt, Artificial
  siRNA construct
ugggcauggaaugugcuga

SEQ ID NO: 834 - RNA, 19 nt, Artificial
  siRNA construct
uugggcauggaaugugcug

SEQ ID NO: 835 - RNA, 19 nt, Artificial
  siRNA construct
cuugggcauggaaugugcu

SEQ ID NO: 836 - RNA, 19 nt, Artificial
  siRNA construct
acuugggcauggaaugugc

SEQ ID NO: 837 - RNA, 19 nt, Artificial
  siRNA construct
uacuugggcauggaaugug

SEQ ID NO: 838 - RNA, 19 nt, Artificial
  siRNA construct
auacuugggcauggaaugu

SEQ ID NO: 839 - RNA, 19 nt, Artificial
  siRNA construct
uccagggagaacugccggc

SEQ ID NO: 840 - RNA, 19 nt, Artificial
  siRNA construct
cuccagggagaacugccgg

SEQ ID NO: 841 - RNA, 19 nt, Artificial
  siRNA construct
gcuccagggagaacugccg

SEQ ID NO: 842 - RNA, 19 nt, Artificial
  siRNA construct
ugcuccagggagaacugcc

SEQ ID NO: 843 - RNA, 19 nt, Artificial
  siRNA construct
gugcuccagggagaacugc

SEQ ID NO: 844 - RNA, 19 nt, Artificial
  siRNA construct
cgugcuccagggagaacug

SEQ ID NO: 845 - RNA, 19 nt, Artificial
  siRNA construct
acgugcuccagggagaacu

SEQ ID NO: 846 - RNA, 19 nt, Artificial
  siRNA construct
gacgugcuccagggagaac

SEQ ID NO: 847 - RNA, 19 nt, Artificial
  siRNA construct
ggacgugcuccagggagaa

SEQ ID NO: 848 - RNA, 19 nt, Artificial
  siRNA construct
uggacgugcuccagggaga

SEQ ID NO: 849 - RNA, 19 nt, Artificial
  siRNA construct
guggacgugcuccagggag

SEQ ID NO: 850 - RNA, 19 nt, Artificial
  siRNA construct
cguggacgugcuccaggga

SEQ ID NO: 851 - RNA, 19 nt, Artificial
  siRNA construct
ccguggacgugcuccaggg

SEQ ID NO: 852 - RNA, 19 nt, Artificial
  siRNA construct
gccguggacgugcuccagg

SEQ ID NO: 853 - RNA, 19 nt, Artificial
  siRNA construct
agccguggacgugcuccag

SEQ ID NO: 854 - RNA, 19 nt, Artificial
  siRNA construct
gagccguggacgugcucca

SEQ ID NO: 855 - RNA, 19 nt, Artificial
  siRNA construct
cgagccguggacgugcucc

SEQ ID NO: 856 - RNA, 19 nt, Artificial
  siRNA construct
ccgagccguggacgugcuc

SEQ ID NO: 857 - RNA, 19 nt, Artificial
  siRNA construct
cccgagccguggacgugcu

SEQ ID NO: 858 - RNA, 19 nt, Artificial
  siRNA construct
gcccgagccguggacgugc

SEQ ID NO: 859 - RNA, 19 nt, Artificial
  siRNA construct
ggcccgagccguggacgug

SEQ ID NO: 860 - RNA, 19 nt, Artificial
  siRNA construct
gggcccgagccguggacgu

SEQ ID NO: 861 - RNA, 19 nt, Artificial
  siRNA construct
gggcguagaggcuggagcu

SEQ ID NO: 862 - RNA, 19 nt, Artificial
  siRNA construct
ugucggagaugaugggucc

SEQ ID NO: 863 - RNA, 19 nt, Artificial
  siRNA construct
augucggagaugauggguc

SEQ ID NO: 864 - RNA, 19 nt, Artificial
  siRNA construct
gaugucggagaugaugggu

SEQ ID NO: 865 - RNA, 19 nt, Artificial
  siRNA construct
ugaugucggagaugauggg

SEQ ID NO: 866 - RNA, 19 nt, Artificial
  siRNA construct
gugaugucggagaugaugg

SEQ ID NO: 867 - RNA, 19 nt, Artificial
  siRNA construct
ggugaugucggagaugaug

SEQ ID NO: 868 - RNA, 19 nt, Artificial
  siRNA construct
cggugaugucggagaugau

SEQ ID NO: 869 - RNA, 19 nt, Artificial
  siRNA construct
ucggugaugucggagauga

SEQ ID NO: 870 - RNA, 19 nt, Artificial
  siRNA construct
cucggugaugucggagaug

SEQ ID NO: 871 - RNA, 19 nt, Artificial
  siRNA construct
gcucggugaugucggagau

SEQ ID NO: 872 - RNA, 19 nt, Artificial
  siRNA construct
agcucggugaugucggaga

SEQ ID NO: 873 - RNA, 19 nt, Artificial
  siRNA construct
cagcucggugaugucggag

SEQ ID NO: 874 - RNA, 19 nt, Artificial
  siRNA construct
ccagcucggugaugucgga

SEQ ID NO: 875 - RNA, 19 nt, Artificial
  siRNA construct
gccagcucggugaugucgg

SEQ ID NO: 876 - RNA, 19 nt, Artificial
  siRNA construct
agccagcucggugaugucg

SEQ ID NO: 877 - RNA, 19 nt, Artificial
  siRNA construct
gagccagcucggugauguc

SEQ ID NO: 878 - RNA, 19 nt, Artificial
  siRNA construct
ggagccagcucggugaugu

SEQ ID NO: 879 - RNA, 19 nt, Artificial
  siRNA construct
aggagccagcucggugaug

SEQ ID NO: 880 - RNA, 19 nt, Artificial
  siRNA construct
caggagccagcucggugau

SEQ ID NO: 881 - RNA, 19 nt, Artificial
  siRNA construct
gcaggagccagcucgguga

SEQ ID NO: 882 - RNA, 19 nt, Artificial
  siRNA construct
ggcaggagccagcucggug

SEQ ID NO: 883 - RNA, 19 nt, Artificial
  siRNA construct
uggcaggagccagcucggu

SEQ ID NO: 884 - RNA, 19 nt, Artificial
  siRNA construct
cuggcaggagccagcucgg

SEQ ID NO: 885 - RNA, 19 nt, Artificial
  siRNA construct
gcuggcaggagccagcucg

SEQ ID NO: 886 - RNA, 19 nt, Artificial
  siRNA construct
ggcuggcaggagccagcuc

SEQ ID NO: 887 - RNA, 19 nt, Artificial
  siRNA construct
gggcuggcaggagccagcu

SEQ ID NO: 888 - RNA, 19 nt, Artificial
  siRNA construct
ucucgucuaugcucccgcc

SEQ ID NO: 889 - RNA, 19 nt, Artificial
  siRNA construct
cucucgucuaugcucccgc

SEQ ID NO: 890 - RNA, 19 nt, Artificial
  siRNA construct
ccucucgucuaugcucccg

SEQ ID NO: 891 - RNA, 19 nt, Artificial
  siRNA construct
gccucucgucuaugcuccc

SEQ ID NO: 892 - RNA, 19 nt, Artificial
  siRNA construct
ggccucucgucuaugcucc

SEQ ID NO: 893 - RNA, 19 nt, Artificial
  siRNA construct
gggccucucgucuaugcuc

SEQ ID NO: 894 - RNA, 19 nt, Artificial
  siRNA construct
uccuugacacgcaccaggg

SEQ ID NO: 895 - RNA, 19 nt, Artificial
  siRNA construct
cuccuugacacgcaccagg

SEQ ID NO: 896 - RNA, 19 nt, Artificial
  siRNA construct
ccuccuugacacgcaccag

SEQ ID NO: 897 - RNA, 19 nt, Artificial
  siRNA construct
uccuccuugacacgcacca

SEQ ID NO: 898 - RNA, 19 nt, Artificial
  siRNA construct
cuccuccuugacacgcacc

SEQ ID NO: 899 - RNA, 19 nt, Artificial
  siRNA construct
gcuccuccuugacacgcac

SEQ ID NO: 900 - RNA, 19 nt, Artificial
  siRNA construct
ggcuccuccuugacacgca

SEQ ID NO: 901 - RNA, 19 nt, Artificial
  siRNA construct
gggcuccuccuugacacgc

SEQ ID NO: 902 - RNA, 19 nt, Artificial
  siRNA construct
ggcucugaggcgggcuggg

SEQ ID NO: 903 - RNA, 19 nt, Artificial
  siRNA construct
gggcucugaggcgggcugg

SEQ ID NO: 904 - RNA, 19 nt, Artificial
  siRNA construct
aguccauagcauccaagug

SEQ ID NO: 905 - RNA, 19 nt, Artificial
  siRNA construct
gaguccauagcauccaagu

SEQ ID NO: 906 - RNA, 19 nt, Artificial
  siRNA construct
uggaguccauagcauccaa

SEQ ID NO: 907 - RNA, 19 nt, Artificial
  siRNA construct
uuggaguccauagcaucca

SEQ ID NO: 908 - RNA, 19 nt, Artificial
  siRNA construct
guuggaguccauagcaucc

SEQ ID NO: 909 - RNA, 19 nt, Artificial
  siRNA construct
gguuggaguccauagcauc

SEQ ID NO: 910 - RNA, 19 nt, Artificial
  siRNA construct
agguuggaguccauagcau

SEQ ID NO: 911 - RNA, 19 nt, Artificial
  siRNA construct
cagguuggaguccauagca

SEQ ID NO: 912 - RNA, 19 nt, Artificial
  siRNA construct
ccagguuggaguccauagc

SEQ ID NO: 913 - RNA, 19 nt, Artificial
  siRNA construct
uccagguuggaguccauag

SEQ ID NO: 914 - RNA, 19 nt, Artificial
  siRNA construct
ucagcauggucugcagguu

SEQ ID NO: 915 - RNA, 19 nt, Artificial
  siRNA construct
cucagcauggucugcaggu

SEQ ID NO: 916 - RNA, 19 nt, Artificial
  siRNA construct
gcucagcauggucugcagg

SEQ ID NO: 917 - RNA, 19 nt, Artificial
  siRNA construct
ugcucagcauggucugcag

SEQ ID NO: 918 - RNA, 19 nt, Artificial
  siRNA construct
cugcucagcauggucugca

SEQ ID NO: 919 - RNA, 19 nt, Artificial
  siRNA construct
gcugcucagcauggucugc

SEQ ID NO: 920 - RNA, 19 nt, Artificial
  siRNA construct
ggcugcucagcauggucug

SEQ ID NO: 921 - RNA, 19 nt, Artificial
  siRNA construct
uggcugcucagcauggucu

SEQ ID NO: 922 - RNA, 19 nt, Artificial
  siRNA construct
guggcugcucagcaugguc

SEQ ID NO: 923 - RNA, 19 nt, Artificial
  siRNA construct
cguggcugcucagcauggu

SEQ ID NO: 924 - RNA, 19 nt, Artificial
  siRNA construct
ccguggcugcucagcaugg

SEQ ID NO: 925 - RNA, 19 nt, Artificial
  siRNA construct
gccguggcugcucagcaug

SEQ ID NO: 926 - RNA, 19 nt, Artificial
  siRNA construct
agccguggcugcucagcau

SEQ ID NO: 927 - RNA, 19 nt, Artificial
  siRNA construct
aagccguggcugcucagca

SEQ ID NO: 928 - RNA, 19 nt, Artificial
  siRNA construct
gaagccguggcugcucagc

SEQ ID NO: 929 - RNA, 19 nt, Artificial
  siRNA construct
ugaagccguggcugcucag

SEQ ID NO: 930 - RNA, 19 nt, Artificial
  siRNA construct
cugaagccguggcugcuca

SEQ ID NO: 931 - RNA, 19 nt, Artificial
  siRNA construct
gcugaagccguggcugcuc

SEQ ID NO: 932 - RNA, 19 nt, Artificial
  siRNA construct
cgcugaagccguggcugcu

SEQ ID NO: 933 - RNA, 19 nt, Artificial
  siRNA construct
acgcugaagccguggcugc

SEQ ID NO: 934 - RNA, 19 nt, Artificial
  siRNA construct
cacgcugaagccguggcug

SEQ ID NO: 935 - RNA, 19 nt, Artificial
  siRNA construct
ccacgcugaagccguggcu

SEQ ID NO: 936 - RNA, 19 nt, Artificial
  siRNA construct
uccacgcugaagccguggc

SEQ ID NO: 937 - RNA, 19 nt, Artificial
  siRNA construct
guccacgcugaagccgugg

SEQ ID NO: 938 - RNA, 19 nt, Artificial
  siRNA construct
uguccacgcugaagccgug

SEQ ID NO: 939 - RNA, 19 nt, Artificial
  siRNA construct
guguccacgcugaagccgu

SEQ ID NO: 940 - RNA, 19 nt, Artificial
  siRNA construct
gguguccacgcugaagccg

SEQ ID NO: 941 - RNA, 19 nt, Artificial
  siRNA construct
ugguguccacgcugaagcc

SEQ ID NO: 942 - RNA, 19 nt, Artificial
  siRNA construct
cugguguccacgcugaagc

SEQ ID NO: 943 - RNA, 19 nt, Artificial
  siRNA construct
ugaacagguccagcagggc

SEQ ID NO: 944 - RNA, 19 nt, Artificial
  siRNA construct
cugaacagguccagcaggg

SEQ ID NO: 945 - RNA, 19 nt, Artificial
  siRNA construct
gcugaacagguccagcagg

SEQ ID NO: 946 - RNA, 19 nt, Artificial
  siRNA construct
ggcugaacagguccagcag

SEQ ID NO: 947 - RNA, 19 nt, Artificial
  siRNA construct
gggcugaacagguccagca

SEQ ID NO: 948 - RNA, 19 nt, Artificial
  siRNA construct
cgggcacggucaccgaggg

SEQ ID NO: 949 - RNA, 19 nt, Artificial
  siRNA construct
ucgggcacggucaccgagg

SEQ ID NO: 950 - RNA, 19 nt, Artificial
  siRNA construct
gucgggcacggucaccgag

SEQ ID NO: 951 - RNA, 19 nt, Artificial
  siRNA construct
ugucgggcacggucaccga

SEQ ID NO: 952 - RNA, 19 nt, Artificial
  siRNA construct
augucgggcacggucaccg

SEQ ID NO: 953 - RNA, 19 nt, Artificial
  siRNA construct
caugucgggcacggucacc

SEQ ID NO: 954 - RNA, 19 nt, Artificial
  siRNA construct
ucaugucgggcacggucac

SEQ ID NO: 955 - RNA, 19 nt, Artificial
  siRNA construct
cucaugucgggcacgguca

SEQ ID NO: 956 - RNA, 19 nt, Artificial
  siRNA construct
gcucaugucgggcacgguc

SEQ ID NO: 957 - RNA, 19 nt, Artificial
  siRNA construct
ggcucaugucgggcacggu

SEQ ID NO: 958 - RNA, 19 nt, Artificial
  siRNA construct
aggcucaugucgggcacgg

SEQ ID NO: 959 - RNA, 19 nt, Artificial
  siRNA construct
caggcucaugucgggcacg

SEQ ID NO: 960 - RNA, 19 nt, Artificial
  siRNA construct
gcaggcucaugucgggcac

SEQ ID NO: 961 - RNA, 19 nt, Artificial
  siRNA construct
ggcaggcucaugucgggca

SEQ ID NO: 962 - RNA, 19 nt, Artificial
  siRNA construct
aggcaggcucaugucgggc

SEQ ID NO: 963 - RNA, 19 nt, Artificial
  siRNA construct
caggcaggcucaugucggg

SEQ ID NO: 964 - RNA, 19 nt, Artificial
  siRNA construct
ucaggcaggcucaugucgg

SEQ ID NO: 965 - RNA, 19 nt, Artificial
  siRNA construct
gucaggcaggcucaugucg

SEQ ID NO: 966 - RNA, 19 nt, Artificial
  siRNA construct
ggucaggcaggcucauguc

SEQ ID NO: 967 - RNA, 19 nt, Artificial
  siRNA construct
aggucaggcaggcucaugu

SEQ ID NO: 968 - RNA, 19 nt, Artificial
  siRNA construct
aaggucaggcaggcucaug

SEQ ID NO: 969 - RNA, 19 nt, Artificial
  siRNA construct
caaggucaggcaggcucau

SEQ ID NO: 970 - RNA, 19 nt, Artificial
  siRNA construct
ucaaggucaggcaggcuca

SEQ ID NO: 971 - RNA, 19 nt, Artificial
  siRNA construct
gucaaggucaggcaggcuc

SEQ ID NO: 972 - RNA, 19 nt, Artificial
  siRNA construct
ugucaaggucaggcaggcu

SEQ ID NO: 973 - RNA, 19 nt, Artificial
  siRNA construct
cugucaaggucaggcaggc

SEQ ID NO: 974 - RNA, 19 nt, Artificial
  siRNA construct
gcugucaaggucaggcagg

SEQ ID NO: 975 - RNA, 19 nt, Artificial
  siRNA construct
ugcugucaaggucaggcag

SEQ ID NO: 976 - RNA, 19 nt, Artificial
  siRNA construct
cugcugucaaggucaggca

SEQ ID NO: 977 - RNA, 19 nt, Artificial
  siRNA construct
gcugcugucaaggucaggc

SEQ ID NO: 978 - RNA, 19 nt, Artificial
  siRNA construct
ggcugcugucaaggucagg

SEQ ID NO: 979 - RNA, 19 nt, Artificial
  siRNA construct
aggcugcugucaaggucag

SEQ ID NO: 980 - RNA, 19 nt, Artificial
  siRNA construct
caggcugcugucaagguca

SEQ ID NO: 981 - RNA, 19 nt, Artificial
  siRNA construct
ccaggcugcugucaagguc

SEQ ID NO: 982 - RNA, 19 nt, Artificial
  siRNA construct
gccaggcugcugucaaggu

SEQ ID NO: 983 - RNA, 19 nt, Artificial
  siRNA construct
acaggagcucuuggauacu

SEQ ID NO: 984 - RNA, 19 nt, Artificial
  siRNA construct
gacaggagcucuuggauac

SEQ ID NO: 985 - RNA, 19 nt, Artificial
  siRNA construct
agacaggagcucuuggaua

SEQ ID NO: 986 - RNA, 19 nt, Artificial
  siRNA construct
gagacaggagcucuuggau

SEQ ID NO: 987 - RNA, 19 nt, Artificial
  siRNA construct
ggagacaggagcucuugga

SEQ ID NO: 988 - RNA, 19 nt, Artificial
  siRNA construct
gggagacaggagcucuugg

SEQ ID NO: 989 - RNA, 19 nt, Artificial
  siRNA construct
aauccgggcugcuguucuc

SEQ ID NO: 990 - RNA, 19 nt, Artificial
  siRNA construct
gaauccgggcugcuguucu

SEQ ID NO: 991 - RNA, 19 nt, Artificial
  siRNA construct
ugaauccgggcugcuguuc

SEQ ID NO: 992 - RNA, 19 nt, Artificial
  siRNA construct
cugaauccgggcugcuguu

SEQ ID NO: 993 - RNA, 19 nt, Artificial
  siRNA construct
ccugaauccgggcugcugu

SEQ ID NO: 994 - RNA, 19 nt, Artificial
  siRNA construct
cccugaauccgggcugcug

SEQ ID NO: 995 - RNA, 19 nt, Artificial
  siRNA construct
ucccugaauccgggcugcu

SEQ ID NO: 996 - RNA, 19 nt, Artificial
  siRNA construct
uucccugaauccgggcugc

SEQ ID NO: 997 - RNA, 19 nt, Artificial
  siRNA construct
cuucccugaauccgggcug

SEQ ID NO: 998 - RNA, 19 nt, Artificial
  siRNA construct
gcuucccugaauccgggcu

SEQ ID NO: 999 - RNA, 19 nt, Artificial
  siRNA construct
ugcuucccugaauccgggc

SEQ ID NO: 1000 - RNA, 19 nt, Artificial
  siRNA construct
cugcuucccugaauccggg

SEQ ID NO: 1001 - RNA, 19 nt, Artificial
  siRNA construct
gcugcuucccugaauccgg

SEQ ID NO: 1002 - RNA, 19 nt, Artificial
  siRNA construct
agcugcuucccugaauccg

SEQ ID NO: 1003 - RNA, 19 nt, Artificial
  siRNA construct
cagcugcuucccugaaucc

SEQ ID NO: 1004 - RNA, 19 nt, Artificial
  siRNA construct
ccagcugcuucccugaauc

SEQ ID NO: 1005 - RNA, 19 nt, Artificial
  siRNA construct
accagcugcuucccugaau

SEQ ID NO: 1006 - RNA, 19 nt, Artificial
  siRNA construct
cgguguccacggagccggg

SEQ ID NO: 1007 - RNA, 19 nt, Artificial
  siRNA construct
ccgguguccacggagccgg

SEQ ID NO: 1008 - RNA, 19 nt, Artificial
  siRNA construct
cccgguguccacggagccg

SEQ ID NO: 1009 - RNA, 19 nt, Artificial
  siRNA construct
ucccgguguccacggagcc

SEQ ID NO: 1010 - RNA, 19 nt, Artificial
  siRNA construct
cucccgguguccacggagc

SEQ ID NO: 1011 - RNA, 19 nt, Artificial
  siRNA construct
gcucccgguguccacggag

SEQ ID NO: 1012 - RNA, 19 nt, Artificial
  siRNA construct
ugcucccgguguccacgga

SEQ ID NO: 1013 - RNA, 19 nt, Artificial
  siRNA construct
agcucaaacagcaccggca

SEQ ID NO: 1014 - RNA, 19 nt, Artificial
  siRNA construct
cagcucaaacagcaccggc

SEQ ID NO: 1015 - RNA, 19 nt, Artificial
  siRNA construct
ccagcucaaacagcaccgg

SEQ ID NO: 1016 - RNA, 19 nt, Artificial
  siRNA construct
cccagcucaaacagcaccg

SEQ ID NO: 1017 - RNA, 19 nt, Artificial
  siRNA construct
ucagcagggagaugguggg

SEQ ID NO: 1018 - RNA, 19 nt, Artificial
  siRNA construct
gucagcagggagauggugg

SEQ ID NO: 1019 - RNA, 19 nt, Artificial
  siRNA construct
ugucagcagggagauggug

SEQ ID NO: 1020 - RNA, 19 nt, Artificial
  siRNA construct
ccuuggcuuugggaggcuc

SEQ ID NO: 1021 - RNA, 19 nt, Artificial
  siRNA construct
uccuuggcuuugggaggcu

SEQ ID NO: 1022 - RNA, 19 nt, Artificial
  siRNA construct
guccuuggcuuugggaggc

SEQ ID NO: 1023 - RNA, 19 nt, Artificial
  siRNA construct
gguccuuggcuuugggagg

SEQ ID NO: 1024 - RNA, 19 nt, Artificial
  siRNA construct
ggguccuuggcuuugggag

SEQ ID NO: 1025 - DNA, 21 bp, Artificial
  siRNA construct
gggcccagcaacgucccggtt

SEQ ID NO: 1026 - DNA, 21 bp, Artificial
  siRNA construct
ggcccagcaacgucccggctt

SEQ ID NO: 1027 - DNA, 21 bp, Artificial
  siRNA construct
gcccagcaacgucccggcctt

SEQ ID NO: 1028 - DNA, 21 bp, Artificial
  siRNA construct
cccagcaacgucccggccutt

SEQ ID NO: 1029 - DNA, 21 bp, Artificial
  siRNA construct
ccagcaacgucccggccuutt

SEQ ID NO: 1030 - DNA, 21 bp, Artificial
  siRNA construct
cagcaacgucccggccuuctt

SEQ ID NO: 1031 - DNA, 21 bp, Artificial
  siRNA construct
agcaacgucccggccuucctt

SEQ ID NO: 1032 - DNA, 21 bp, Artificial
  siRNA construct
gcaacgucccggccuuccutt

SEQ ID NO: 1033 - DNA, 21 bp, Artificial
  siRNA construct
caacgucccggccuuccugtt

SEQ ID NO: 1034 - DNA, 21 bp, Artificial
  siRNA construct
ucaggaaggccgggacguutt

SEQ ID NO: 1035 - DNA, 21 bp, Artificial
  siRNA construct
acgucccggccuuccugactt

SEQ ID NO: 1036 - DNA, 21 bp, Artificial
  siRNA construct
cgucccggccuuccugacctt

SEQ ID NO: 1037 - DNA, 21 bp, Artificial
  siRNA construct
gucccggccuuccugaccatt

SEQ ID NO: 1038 - DNA, 21 bp, Artificial
  siRNA construct
ccggccuuccugaccaagctt

SEQ ID NO: 1039 - DNA, 21 bp, Artificial
  siRNA construct
cggccuuccugaccaagcutt

SEQ ID NO: 1040 - DNA, 21 bp, Artificial
  siRNA construct
ggccuuccugaccaagcugtt

SEQ ID NO: 1041 - DNA, 21 bp, Artificial
  siRNA construct
gccuuccugaccaagcugutt

SEQ ID NO: 1042 - DNA, 21 bp, Artificial
  siRNA construct
ccuuccugaccaagcugugtt

SEQ ID NO: 1043 - DNA, 21 bp, Artificial
  siRNA construct
cuuccugaccaagcuguggtt

SEQ ID NO: 1044 - DNA, 21 bp, Artificial
  siRNA construct
uuccugaccaagcuguggatt

SEQ ID NO: 1045 - DNA, 21 bp, Artificial
  siRNA construct
uccugaccaagcuguggactt

SEQ ID NO: 1046 - DNA, 21 bp, Artificial
  siRNA construct
ccugaccaagcuguggacctt

SEQ ID NO: 1047 - DNA, 21 bp, Artificial
  siRNA construct
cugaccaagcuguggaccctt

SEQ ID NO: 1048 - DNA, 21 bp, Artificial
  siRNA construct
ugaccaagcuguggacccutt

SEQ ID NO: 1049 - DNA, 21 bp, Artificial
  siRNA construct
gaccaagcuguggacccuctt

SEQ ID NO: 1050 - DNA, 21 bp, Artificial
  siRNA construct
accaagcuguggacccucgtt

SEQ ID NO: 1051 - DNA, 21 bp, Artificial
  siRNA construct
ccaagcuguggacccucgutt

SEQ ID NO: 1052 - DNA, 21 bp, Artificial
  siRNA construct
caagcuguggacccucgugtt

SEQ ID NO: 1053 - DNA, 21 bp, Artificial
  siRNA construct
aagcuguggacccucgugatt

SEQ ID NO: 1054 - DNA, 21 bp, Artificial
  siRNA construct
agcuguggacccucgugagtt

SEQ ID NO: 1055 - DNA, 21 bp, Artificial
  siRNA construct
gcuguggacccucgugagctt

SEQ ID NO: 1056 - DNA, 21 bp, Artificial
  siRNA construct
cuguggacccucgugagcgtt

SEQ ID NO: 1057 - DNA, 21 bp, Artificial
  siRNA construct
uguggacccucgugagcgatt

SEQ ID NO: 1058 - DNA, 21 bp, Artificial
  siRNA construct
guggacccucgugagcgactt

SEQ ID NO: 1059 - DNA, 21 bp, Artificial
  siRNA construct
uggacccucgugagcgacctt

SEQ ID NO: 1060 - DNA, 21 bp, Artificial
  siRNA construct
ggacccucgugagcgaccctt

SEQ ID NO: 1061 - DNA, 21 bp, Artificial
  siRNA construct
gacccucgugagcgacccgtt

SEQ ID NO: 1062 - DNA, 21 bp, Artificial
  siRNA construct
acccucgugagcgacccggtt

SEQ ID NO: 1063 - DNA, 21 bp, Artificial
  siRNA construct
cccucgugagcgacccggatt

SEQ ID NO: 1064 - DNA, 21 bp, Artificial
  siRNA construct
ccucgugagcgacccggactt

SEQ ID NO: 1065 - DNA, 21 bp, Artificial
  siRNA construct
cucgugagcgacccggacatt

SEQ ID NO: 1066 - DNA, 21 bp, Artificial
  siRNA construct
ucgugagcgacccggacactt

SEQ ID NO: 1067 - DNA, 21 bp, Artificial
  siRNA construct
cgugagcgacccggacacctt

SEQ ID NO: 1068 - DNA, 21 bp, Artificial
  siRNA construct
gugagcgacccggacaccgtt

SEQ ID NO: 1069 - DNA, 21 bp, Artificial
  siRNA construct
ugagcgacccggacaccgatt

SEQ ID NO: 1070 - DNA, 21 bp, Artificial
  siRNA construct
gagcgacccggacaccgactt

SEQ ID NO: 1071 - DNA, 21 bp, Artificial
  siRNA construct
agcgacccggacaccgacgtt

SEQ ID NO: 1072 - DNA, 21 bp, Artificial
  siRNA construct
gcgacccggacaccgacgctt

SEQ ID NO: 1073 - DNA, 21 bp, Artificial
  siRNA construct
cucaucugcuggagcccgatt

SEQ ID NO: 1074 - DNA, 21 bp, Artificial
  siRNA construct
ucaucugcuggagcccgagtt

SEQ ID NO: 1075 - DNA, 21 bp, Artificial
  siRNA construct
guguucgaccagggccagutt

SEQ ID NO: 1076 - DNA, 21 bp, Artificial
  siRNA construct
uguucgaccagggccaguutt

SEQ ID NO: 1077 - DNA, 21 bp, Artificial
  siRNA construct
guucgaccagggccaguuutt

SEQ ID NO: 1078 - DNA, 21 bp, Artificial
  siRNA construct
uucgaccagggccaguuugtt

SEQ ID NO: 1079 - DNA, 21 bp, Artificial
  siRNA construct
ucgaccagggccaguuugctt

SEQ ID NO: 1080 - DNA, 21 bp, Artificial
  siRNA construct
cgaccagggccaguuugcctt

SEQ ID NO: 1081 - DNA, 21 bp, Artificial
  siRNA construct
gaccagggccaguuugccatt

SEQ ID NO: 1082 - DNA, 21 bp, Artificial
  siRNA construct
accagggccaguuugccaatt

SEQ ID NO: 1083 - DNA, 21 bp, Artificial
  siRNA construct
ccagggccaguuugccaagtt

SEQ ID NO: 1084 - DNA, 21 bp, Artificial
  siRNA construct
cagggccaguuugccaaggtt

SEQ ID NO: 1085 - DNA, 21 bp, Artificial
  siRNA construct
agggccaguuugccaaggatt

SEQ ID NO: 1086 - DNA, 21 bp, Artificial
  siRNA construct
gggccaguuugccaaggagtt

SEQ ID NO: 1087 - DNA, 21 bp, Artificial
  siRNA construct
ggccaguuugccaaggaggtt

SEQ ID NO: 1088 - DNA, 21 bp, Artificial
  siRNA construct
gccaguuugccaaggaggutt

SEQ ID NO: 1089 - DNA, 21 bp, Artificial
  siRNA construct
ccaguuugccaaggaggugtt

SEQ ID NO: 1090 - DNA, 21 bp, Artificial
  siRNA construct
caguuugccaaggaggugctt

SEQ ID NO: 1091 - DNA, 21 bp, Artificial
  siRNA construct
aguuugccaaggaggugcutt

SEQ ID NO: 1092 - DNA, 21 bp, Artificial
  siRNA construct
guuugccaaggaggugcugtt

SEQ ID NO: 1093 - DNA, 21 bp, Artificial
  siRNA construct
uuugccaaggaggugcugctt

SEQ ID NO: 1094 - DNA, 21 bp, Artificial
  siRNA construct
uugccaaggaggugcugcctt

SEQ ID NO: 1095 - DNA, 21 bp, Artificial
  siRNA construct
ugccaaggaggugcugccctt

SEQ ID NO: 1096 - DNA, 21 bp, Artificial
  siRNA construct
gccaaggaggugcugcccatt

SEQ ID NO: 1097 - DNA, 21 bp, Artificial
  siRNA construct
ccaaggaggugcugcccaatt

SEQ ID NO: 1098 - DNA, 21 bp, Artificial
  siRNA construct
caaggaggugcugcccaagtt

SEQ ID NO: 1099 - DNA, 21 bp, Artificial
  siRNA construct
aaggaggugcugcccaagutt

SEQ ID NO: 1100 - DNA, 21 bp, Artificial
  siRNA construct
aggaggugcugcccaaguatt

SEQ ID NO: 1101 - DNA, 21 bp, Artificial
  siRNA construct
uucaagcacaacaacauggtt

SEQ ID NO: 1102 - DNA, 21 bp, Artificial
  siRNA construct
ucaagcacaacaacauggctt

SEQ ID NO: 1103 - DNA, 21 bp, Artificial
  siRNA construct
caagcacaacaacauggcctt

SEQ ID NO: 1104 - DNA, 21 bp, Artificial
  siRNA construct
aagcacaacaacauggccatt

SEQ ID NO: 1105 - DNA, 21 bp, Artificial
  siRNA construct
agcacaacaacauggccagtt

SEQ ID NO: 1106 - DNA, 21 bp, Artificial
  siRNA construct
gcacaacaacauggccagctt

SEQ ID NO: 1107 - DNA, 21 bp, Artificial
  siRNA construct
cacaacaacauggccagcutt

SEQ ID NO: 1108 - DNA, 21 bp, Artificial
  siRNA construct
acaacaacauggccagcuutt

SEQ ID NO: 1109 - DNA, 21 bp, Artificial
  siRNA construct
aacaacauggccagcuucgtt

SEQ ID NO: 1110 - DNA, 21 bp, Artificial
  siRNA construct
acaacauggccagcuucgutt

SEQ ID NO: 1111 - DNA, 21 bp, Artificial
  siRNA construct
caacauggccagcuucgugtt

SEQ ID NO: 1112 - DNA, 21 bp, Artificial
  siRNA construct
aacauggccagcuucgugctt

SEQ ID NO: 1113 - DNA, 21 bp, Artificial
  siRNA construct
acauggccagcuucgugcgtt

SEQ ID NO: 1114 - DNA, 21 bp, Artificial
  siRNA construct
cauggccagcuucgugcggtt

SEQ ID NO: 1115 - DNA, 21 bp, Artificial
  siRNA construct
auggccagcuucgugcggctt

SEQ ID NO: 1116 - DNA, 21 bp, Artificial
  siRNA construct
uggccagcuucgugcggcatt

SEQ ID NO: 1117 - DNA, 21 bp, Artificial
  siRNA construct
uggucaagccagagagagatt

SEQ ID NO: 1118 - DNA, 21 bp, Artificial
  siRNA construct
ggucaagccagagagagactt

SEQ ID NO: 1119 - DNA, 21 bp, Artificial
  siRNA construct
gucaagccagagagagacgtt

SEQ ID NO: 1120 - DNA, 21 bp, Artificial
  siRNA construct
ucaagccagagagagacgatt

SEQ ID NO: 1121 - DNA, 21 bp, Artificial
  siRNA construct
caagccagagagagacgactt

SEQ ID NO: 1122 - DNA, 21 bp, Artificial
  siRNA construct
aagccagagagagacgacatt

SEQ ID NO: 1123 - DNA, 21 bp, Artificial
  siRNA construct
agccagagagagacgacactt

SEQ ID NO: 1124 - DNA, 21 bp, Artificial
  siRNA construct
gccagagagagacgacacgtt

SEQ ID NO: 1125 - DNA, 21 bp, Artificial
  siRNA construct
ccagagagagacgacacggtt

SEQ ID NO: 1126 - DNA, 21 bp, Artificial
  siRNA construct
cagagagagacgacacggatt

SEQ ID NO: 1127 - DNA, 21 bp, Artificial
  siRNA construct
agagagagacgacacggagtt

SEQ ID NO: 1128 - DNA, 21 bp, Artificial
  siRNA construct
gagagagacgacacggagutt

SEQ ID NO: 1129 - DNA, 21 bp, Artificial
  siRNA construct
agagagacgacacggaguutt

SEQ ID NO: 1130 - DNA, 21 bp, Artificial
  siRNA construct
gagagacgacacggaguuctt

SEQ ID NO: 1131 - DNA, 21 bp, Artificial
  siRNA construct
agagacgacacggaguucctt

SEQ ID NO: 1132 - DNA, 21 bp, Artificial
  siRNA construct
gagacgacacggaguuccatt

SEQ ID NO: 1133 - DNA, 21 bp, Artificial
  siRNA construct
agacgacacggaguuccagtt

SEQ ID NO: 1134 - DNA, 21 bp, Artificial
  siRNA construct
gacgacacggaguuccagctt

SEQ ID NO: 1135 - DNA, 21 bp, Artificial
  siRNA construct
acgacacggaguuccagcatt

SEQ ID NO: 1136 - DNA, 21 bp, Artificial
  siRNA construct
cgacacggaguuccagcactt

SEQ ID NO: 1137 - DNA, 21 bp, Artificial
  siRNA construct
gacacggaguuccagcacctt

SEQ ID NO: 1138 - DNA, 21 bp, Artificial
  siRNA construct
acacggaguuccagcaccctt

SEQ ID NO: 1139 - DNA, 21 bp, Artificial
  siRNA construct
ggccaggagcagcuccuugtt

SEQ ID NO: 1140 - DNA, 21 bp, Artificial
  siRNA construct
gccaggagcagcuccuugatt

SEQ ID NO: 1141 - DNA, 21 bp, Artificial
  siRNA construct
ccaggagcagcuccuugagtt

SEQ ID NO: 1142 - DNA, 21 bp, Artificial
  siRNA construct
caggagcagcuccuugagatt

SEQ ID NO: 1143 - DNA, 21 bp, Artificial
  siRNA construct
aggagcagcuccuugagaatt

SEQ ID NO: 1144 - DNA, 21 bp, Artificial
  siRNA construct
ggagcagcuccuugagaactt

SEQ ID NO: 1145 - DNA, 21 bp, Artificial
  siRNA construct
gagcagcuccuugagaacatt

SEQ ID NO: 1146 - DNA, 21 bp, Artificial
  siRNA construct
agcagcuccuugagaacautt

SEQ ID NO: 1147 - DNA, 21 bp, Artificial
  siRNA construct
gcagcuccuugagaacauctt

SEQ ID NO: 1148 - DNA, 21 bp, Artificial
  siRNA construct
cagcuccuugagaacaucatt

SEQ ID NO: 1149 - DNA, 21 bp, Artificial
  siRNA construct
agcuccuugagaacaucaatt

SEQ ID NO: 1150 - DNA, 21 bp, Artificial
  siRNA construct
gcuccuugagaacaucaagtt

SEQ ID NO: 1151 - DNA, 21 bp, Artificial
  siRNA construct
cuccuugagaacaucaagatt

SEQ ID NO: 1152 - DNA, 21 bp, Artificial
  siRNA construct
uccuugagaacaucaagagtt

SEQ ID NO: 1153 - DNA, 21 bp, Artificial
  siRNA construct
ccuugagaacaucaagaggtt

SEQ ID NO: 1154 - DNA, 21 bp, Artificial
  siRNA construct
cuugagaacaucaagaggatt

SEQ ID NO: 1155 - DNA, 21 bp, Artificial
  siRNA construct
uugagaacaucaagaggaatt

SEQ ID NO: 1156 - DNA, 21 bp, Artificial
  siRNA construct
ugagaacaucaagaggaaatt

SEQ ID NO: 1157 - DNA, 21 bp, Artificial
  siRNA construct
gagaacaucaagaggaaagtt

SEQ ID NO: 1158 - DNA, 21 bp, Artificial
  siRNA construct
agaacaucaagaggaaagutt

SEQ ID NO: 1159 - DNA, 21 bp, Artificial
  siRNA construct
gaacaucaagaggaaagugtt

SEQ ID NO: 1160 - DNA, 21 bp, Artificial
  siRNA construct
aacaucaagaggaaagugatt

SEQ ID NO: 1161 - DNA, 21 bp, Artificial
  siRNA construct
acaucaagaggaaagugactt

SEQ ID NO: 1162 - DNA, 21 bp, Artificial
  siRNA construct
caucaagaggaaagugacctt

SEQ ID NO: 1163 - DNA, 21 bp, Artificial
  siRNA construct
aucaagaggaaagugaccatt

SEQ ID NO: 1164 - DNA, 21 bp, Artificial
  siRNA construct
ucaagaggaaagugaccagtt

SEQ ID NO: 1165 - DNA, 21 bp, Artificial
  siRNA construct
caagaggaaagugaccagutt

SEQ ID NO: 1166 - DNA, 21 bp, Artificial
  siRNA construct
aagaggaaagugaccagugtt

SEQ ID NO: 1167 - DNA, 21 bp, Artificial
  siRNA construct
gaggaaagugaccagugugtt

SEQ ID NO: 1168 - DNA, 21 bp, Artificial
  siRNA construct
aggaaagugaccagugugutt

SEQ ID NO: 1169 - DNA, 21 bp, Artificial
  siRNA construct
ggaaagugaccaguguguctt

SEQ ID NO: 1170 - DNA, 21 bp, Artificial
  siRNA construct
gaaagugaccagugugucctt

SEQ ID NO: 1171 - DNA, 21 bp, Artificial
  siRNA construct
aaagugaccaguguguccatt

SEQ ID NO: 1172 - DNA, 21 bp, Artificial
  siRNA construct
aagugaccaguguguccactt

SEQ ID NO: 1173 - DNA, 21 bp, Artificial
  siRNA construct
agugaccaguguguccacctt

SEQ ID NO: 1174 - DNA, 21 bp, Artificial
  siRNA construct
gugaccaguguguccaccctt

SEQ ID NO: 1175 - DNA, 21 bp, Artificial
  siRNA construct
ugaccaguguguccacccutt

SEQ ID NO: 1176 - DNA, 21 bp, Artificial
  siRNA construct
gaccaguguguccacccugtt

SEQ ID NO: 1177 - DNA, 21 bp, Artificial
  siRNA construct
accaguguguccacccugatt

SEQ ID NO: 1178 - DNA, 21 bp, Artificial
  siRNA construct
ccaguguguccacccugaatt

SEQ ID NO: 1179 - DNA, 21 bp, Artificial
  siRNA construct
caguguguccacccugaagtt

SEQ ID NO: 1180 - DNA, 21 bp, Artificial
  siRNA construct
aguguguccacccugaagatt

SEQ ID NO: 1181 - DNA, 21 bp, Artificial
  siRNA construct
guguguccacccugaagagtt

SEQ ID NO: 1182 - DNA, 21 bp, Artificial
  siRNA construct
uguguccacccugaagagutt

SEQ ID NO: 1183 - DNA, 21 bp, Artificial
  siRNA construct
guguccacccugaagagugtt

SEQ ID NO: 1184 - DNA, 21 bp, Artificial
  siRNA construct
uguccacccugaagagugatt

SEQ ID NO: 1185 - DNA, 21 bp, Artificial
  siRNA construct
guccacccugaagagugaatt

SEQ ID NO: 1186 - DNA, 21 bp, Artificial
  siRNA construct
uccacccugaagagugaagtt

SEQ ID NO: 1187 - DNA, 21 bp, Artificial
  siRNA construct
ccacccugaagagugaagatt

SEQ ID NO: 1188 - DNA, 21 bp, Artificial
  siRNA construct
cacccugaagagugaagactt

SEQ ID NO: 1189 - DNA, 21 bp, Artificial
  siRNA construct
acccugaagagugaagacatt

SEQ ID NO: 1190 - DNA, 21 bp, Artificial
  siRNA construct
cccugaagagugaagacautt

SEQ ID NO: 1191 - DNA, 21 bp, Artificial
  siRNA construct
ccugaagagugaagacauatt

SEQ ID NO: 1192 - DNA, 21 bp, Artificial
  siRNA construct
cugaagagugaagacauaatt

SEQ ID NO: 1193 - DNA, 21 bp, Artificial
  siRNA construct
ugaagagugaagacauaaatt

SEQ ID NO: 1194 - DNA, 21 bp, Artificial
  siRNA construct
gaagagugaagacauaaagtt

SEQ ID NO: 1195 - DNA, 21 bp, Artificial
  siRNA construct
aagagugaagacauaaagatt

SEQ ID NO: 1196 - DNA, 21 bp, Artificial
  siRNA construct
agagugaagacauaaagautt

SEQ ID NO: 1197 - DNA, 21 bp, Artificial
  siRNA construct
gagugaagacauaaagauctt

SEQ ID NO: 1198 - DNA, 21 bp, Artificial
  siRNA construct
agugaagacauaaagaucctt

SEQ ID NO: 1199 - DNA, 21 bp, Artificial
  siRNA construct
gugaagacauaaagauccgtt

SEQ ID NO: 1200 - DNA, 21 bp, Artificial
  siRNA construct
gucaccaagcugcugacggtt

SEQ ID NO: 1201 - DNA, 21 bp, Artificial
  siRNA construct
ucaccaagcugcugacggatt

SEQ ID NO: 1202 - DNA, 21 bp, Artificial
  siRNA construct
caccaagcugcugacggactt

SEQ ID NO: 1203 - DNA, 21 bp, Artificial
  siRNA construct
accaagcugcugacggacgtt

SEQ ID NO: 1204 - DNA, 21 bp, Artificial
  siRNA construct
ccaagcugcugacggacgutt

SEQ ID NO: 1205 - DNA, 21 bp, Artificial
  siRNA construct
caagcugcugacggacgugtt

SEQ ID NO: 1206 - DNA, 21 bp, Artificial
  siRNA construct
aagcugcugacggacgugctt

SEQ ID NO: 1207 - DNA, 21 bp, Artificial
  siRNA construct
agcugcugacggacgugcatt

SEQ ID NO: 1208 - DNA, 21 bp, Artificial
  siRNA construct
gcugcugacggacgugcagtt

SEQ ID NO: 1209 - DNA, 21 bp, Artificial
  siRNA construct
cugcugacggacgugcagctt

SEQ ID NO: 1210 - DNA, 21 bp, Artificial
  siRNA construct
ugcugacggacgugcagcutt

SEQ ID NO: 1211 - DNA, 21 bp, Artificial
  siRNA construct
gcugacggacgugcagcugtt

SEQ ID NO: 1212 - DNA, 21 bp, Artificial
  siRNA construct
cugacggacgugcagcugatt

SEQ ID NO: 1213 - DNA, 21 bp, Artificial
  siRNA construct
ugacggacgugcagcugautt

SEQ ID NO: 1214 - DNA, 21 bp, Artificial
  siRNA construct
gacggacgugcagcugaugtt

SEQ ID NO: 1215 - DNA, 21 bp, Artificial
  siRNA construct
acggacgugcagcugaugatt

SEQ ID NO: 1216 - DNA, 21 bp, Artificial
  siRNA construct
cggacgugcagcugaugaatt

SEQ ID NO: 1217 - DNA, 21 bp, Artificial
  siRNA construct
ggacgugcagcugaugaagtt

SEQ ID NO: 1218 - DNA, 21 bp, Artificial
  siRNA construct
gacgugcagcugaugaaggtt

SEQ ID NO: 1219 - DNA, 21 bp, Artificial
  siRNA construct
acgugcagcugaugaagggtt

SEQ ID NO: 1220 - DNA, 21 bp, Artificial
  siRNA construct
gagaaugaggcucuguggctt

SEQ ID NO: 1221 - DNA, 21 bp, Artificial
  siRNA construct
agaaugaggcucuguggcgtt

SEQ ID NO: 1222 - DNA, 21 bp, Artificial
  siRNA construct
gaaugaggcucuguggcggtt

SEQ ID NO: 1223 - DNA, 21 bp, Artificial
  siRNA construct
aaugaggcucuguggcgggtt

SEQ ID NO: 1224 - DNA, 21 bp, Artificial
  siRNA construct
augaggcucuguggcgggatt

SEQ ID NO: 1225 - DNA, 21 bp, Artificial
  siRNA construct
ugaggcucuguggcgggagtt

SEQ ID NO: 1226 - DNA, 21 bp, Artificial
  siRNA construct
gaggcucuguggcgggaggtt

SEQ ID NO: 1227 - DNA, 21 bp, Artificial
  siRNA construct
aggcucuguggcgggaggutt

SEQ ID NO: 1228 - DNA, 21 bp, Artificial
  siRNA construct
ggcucuguggcgggaggugtt

SEQ ID NO: 1229 - DNA, 21 bp, Artificial
  siRNA construct
gcucuguggcgggagguggtt

SEQ ID NO: 1230 - DNA, 21 bp, Artificial
  siRNA construct
cucuguggcgggagguggctt

SEQ ID NO: 1231 - DNA, 21 bp, Artificial
  siRNA construct
ucuguggcgggagguggcctt

SEQ ID NO: 1232 - DNA, 21 bp, Artificial
  siRNA construct
cuguggcgggagguggccatt

SEQ ID NO: 1233 - DNA, 21 bp, Artificial
  siRNA construct
uguggcgggagguggccagtt

SEQ ID NO: 1234 - DNA, 21 bp, Artificial
  siRNA construct
guggcgggagguggccagctt

SEQ ID NO: 1235 - DNA, 21 bp, Artificial
  siRNA construct
uggcgggagguggccagcctt

SEQ ID NO: 1236 - DNA, 21 bp, Artificial
  siRNA construct
ggcgggagguggccagccutt

SEQ ID NO: 1237 - DNA, 21 bp, Artificial
  siRNA construct
gcgggagguggccagccuutt

SEQ ID NO: 1238 - DNA, 21 bp, Artificial
  siRNA construct
cgggagguggccagccuuctt

SEQ ID NO: 1239 - DNA, 21 bp, Artificial
  siRNA construct
gggagguggccagccuucgtt

SEQ ID NO: 1240 - DNA, 21 bp, Artificial
  siRNA construct
ggagguggccagccuucggtt

SEQ ID NO: 1241 - DNA, 21 bp, Artificial
  siRNA construct
gagguggccagccuucggctt

SEQ ID NO: 1242 - DNA, 21 bp, Artificial
  siRNA construct
agguggccagccuucggcatt

SEQ ID NO: 1243 - DNA, 21 bp, Artificial
  siRNA construct
gguggccagccuucggcagtt

SEQ ID NO: 1244 - DNA, 21 bp, Artificial
  siRNA construct
guggccagccuucggcagatt

SEQ ID NO: 1245 - DNA, 21 bp, Artificial
  siRNA construct
uggccagccuucggcagaatt

SEQ ID NO: 1246 - DNA, 21 bp, Artificial
  siRNA construct
ggccagccuucggcagaagtt

SEQ ID NO: 1247 - DNA, 21 bp, Artificial
  siRNA construct
gccagccuucggcagaagctt

SEQ ID NO: 1248 - DNA, 21 bp, Artificial
  siRNA construct
ccagccuucggcagaagcatt

SEQ ID NO: 1249 - DNA, 21 bp, Artificial
  siRNA construct
cagccuucggcagaagcautt

SEQ ID NO: 1250 - DNA, 21 bp, Artificial
  siRNA construct
agccuucggcagaagcaugtt

SEQ ID NO: 1251 - DNA, 21 bp, Artificial
  siRNA construct
gccuucggcagaagcaugctt

SEQ ID NO: 1252 - DNA, 21 bp, Artificial
  siRNA construct
ccuucggcagaagcaugcctt

SEQ ID NO: 1253 - DNA, 21 bp, Artificial
  siRNA construct
cuucggcagaagcaugccctt

SEQ ID NO: 1254 - DNA, 21 bp, Artificial
  siRNA construct
uucggcagaagcaugcccatt

SEQ ID NO: 1255 - DNA, 21 bp, Artificial
  siRNA construct
ucggcagaagcaugcccagtt

SEQ ID NO: 1256 - DNA, 21 bp, Artificial
  siRNA construct
cggcagaagcaugcccagctt

SEQ ID NO: 1257 - DNA, 21 bp, Artificial
  siRNA construct
ggcagaagcaugcccagcatt

SEQ ID NO: 1258 - DNA, 21 bp, Artificial
  siRNA construct
gcagaagcaugcccagcaatt

SEQ ID NO: 1259 - DNA, 21 bp, Artificial
  siRNA construct
cagaagcaugcccagcaactt

SEQ ID NO: 1260 - DNA, 21 bp, Artificial
  siRNA construct
agaagcaugcccagcaacatt

SEQ ID NO: 1261 - DNA, 21 bp, Artificial
  siRNA construct
gaagcaugcccagcaacagtt

SEQ ID NO: 1262 - DNA, 21 bp, Artificial
  siRNA construct
aagcaugcccagcaacagatt

SEQ ID NO: 1263 - DNA, 21 bp, Artificial
  siRNA construct
agcaugcccagcaacagaatt

SEQ ID NO: 1264 - DNA, 21 bp, Artificial
  siRNA construct
gcaugcccagcaacagaaatt

SEQ ID NO: 1265 - DNA, 21 bp, Artificial
  siRNA construct
caugcccagcaacagaaagtt

SEQ ID NO: 1266 - DNA, 21 bp, Artificial
  siRNA construct
augcccagcaacagaaagutt

SEQ ID NO: 1267 - DNA, 21 bp, Artificial
  siRNA construct
ugcccagcaacagaaaguctt

SEQ ID NO: 1268 - DNA, 21 bp, Artificial
  siRNA construct
gcccagcaacagaaagucgtt

SEQ ID NO: 1269 - DNA, 21 bp, Artificial
  siRNA construct
cccagcaacagaaagucgutt

SEQ ID NO: 1270 - DNA, 21 bp, Artificial
  siRNA construct
ccagcaacagaaagucguctt

SEQ ID NO: 1271 - DNA, 21 bp, Artificial
  siRNA construct
cagcaacagaaagucgucatt

SEQ ID NO: 1272 - DNA, 21 bp, Artificial
  siRNA construct
agcaacagaaagucgucaatt

SEQ ID NO: 1273 - DNA, 21 bp, Artificial
  siRNA construct
gcaacagaaagucgucaactt

SEQ ID NO: 1274 - DNA, 21 bp, Artificial
  siRNA construct
caacagaaagucgucaacatt

SEQ ID NO: 1275 - DNA, 21 bp, Artificial
  siRNA construct
aacagaaagucgucaacaatt

SEQ ID NO: 1276 - DNA, 21 bp, Artificial
  siRNA construct
acagaaagucgucaacaagtt

SEQ ID NO: 1277 - DNA, 21 bp, Artificial
  siRNA construct
cagaaagucgucaacaagctt

SEQ ID NO: 1278 - DNA, 21 bp, Artificial
  siRNA construct
agaaagucgucaacaagcutt

SEQ ID NO: 1279 - DNA, 21 bp, Artificial
  siRNA construct
gaaagucgucaacaagcuctt

SEQ ID NO: 1280 - DNA, 21 bp, Artificial
  siRNA construct
aaagucgucaacaagcucatt

SEQ ID NO: 1281 - DNA, 21 bp, Artificial
  siRNA construct
aagucgucaacaagcucautt

SEQ ID NO: 1282 - DNA, 21 bp, Artificial
  siRNA construct
agucgucaacaagcucauutt

SEQ ID NO: 1283 - DNA, 21 bp, Artificial
  siRNA construct
gucgucaacaagcucauuctt

SEQ ID NO: 1284 - DNA, 21 bp, Artificial
  siRNA construct
ucgucaacaagcucauucatt

SEQ ID NO: 1285 - DNA, 21 bp, Artificial
  siRNA construct
cgucaacaagcucauucagtt

SEQ ID NO: 1286 - DNA, 21 bp, Artificial
  siRNA construct
gucaacaagcucauucagutt

SEQ ID NO: 1287 - DNA, 21 bp, Artificial
  siRNA construct
ucaacaagcucauucaguutt

SEQ ID NO: 1288 - DNA, 21 bp, Artificial
  siRNA construct
caacaagcucauucaguuctt

SEQ ID NO: 1289 - DNA, 21 bp, Artificial
  siRNA construct
aacaagcucauucaguucctt

SEQ ID NO: 1290 - DNA, 21 bp, Artificial
  siRNA construct
acaagcucauucaguuccutt

SEQ ID NO: 1291 - DNA, 21 bp, Artificial
  siRNA construct
caagcucauucaguuccugtt

SEQ ID NO: 1292 - DNA, 21 bp, Artificial
  siRNA construct
aagcucauucaguuccugatt

SEQ ID NO: 1293 - DNA, 21 bp, Artificial
  siRNA construct
agcucauucaguuccugautt

SEQ ID NO: 1294 - DNA, 21 bp, Artificial
  siRNA construct
gcucauucaguuccugauctt

SEQ ID NO: 1295 - DNA, 21 bp, Artificial
  siRNA construct
cucauucaguuccugaucutt

SEQ ID NO: 1296 - DNA, 21 bp, Artificial
  siRNA construct
ucauucaguuccugaucuctt

SEQ ID NO: 1297 - DNA, 21 bp, Artificial
  siRNA construct
cauucaguuccugaucucatt

SEQ ID NO: 1298 - DNA, 21 bp, Artificial
  siRNA construct
auucaguuccugaucucactt

SEQ ID NO: 1299 - DNA, 21 bp, Artificial
  siRNA construct
uucaguuccugaucucacutt

SEQ ID NO: 1300 - DNA, 21 bp, Artificial
  siRNA construct
ucaguuccugaucucacugtt

SEQ ID NO: 1301 - DNA, 21 bp, Artificial
  siRNA construct
caguuccugaucucacuggtt

SEQ ID NO: 1302 - DNA, 21 bp, Artificial
  siRNA construct
aguuccugaucucacuggutt

SEQ ID NO: 1303 - DNA, 21 bp, Artificial
  siRNA construct
uuccugaucucacuggugctt

SEQ ID NO: 1304 - DNA, 21 bp, Artificial
  siRNA construct
uccugaucucacuggugcatt

SEQ ID NO: 1305 - DNA, 21 bp, Artificial
  siRNA construct
ccugaucucacuggugcagtt

SEQ ID NO: 1306 - DNA, 21 bp, Artificial
  siRNA construct
ugaucucacuggugcaguctt

SEQ ID NO: 1307 - DNA, 21 bp, Artificial
  siRNA construct
gaucucacuggugcagucatt

SEQ ID NO: 1308 - DNA, 21 bp, Artificial
  siRNA construct
aucucacuggugcagucaatt

SEQ ID NO: 1309 - DNA, 21 bp, Artificial
  siRNA construct
ucucacuggugcagucaaatt

SEQ ID NO: 1310 - DNA, 21 bp, Artificial
  siRNA construct
cucacuggugcagucaaactt

SEQ ID NO: 1311 - DNA, 21 bp, Artificial
  siRNA construct
cacuggugcagucaaaccgtt

SEQ ID NO: 1312 - DNA, 21 bp, Artificial
  siRNA construct
acuggugcagucaaaccggtt

SEQ ID NO: 1313 - DNA, 21 bp, Artificial
  siRNA construct
cuggugcagucaaaccggatt

SEQ ID NO: 1314 - DNA, 21 bp, Artificial
  siRNA construct
uggugcagucaaaccggautt

SEQ ID NO: 1315 - DNA, 21 bp, Artificial
  siRNA construct
ggugcagucaaaccggauctt

SEQ ID NO: 1316 - DNA, 21 bp, Artificial
  siRNA construct
gugcagucaaaccggaucctt

SEQ ID NO: 1317 - DNA, 21 bp, Artificial
  siRNA construct
ugcagucaaaccggauccutt

SEQ ID NO: 1318 - DNA, 21 bp, Artificial
  siRNA construct
gcagucaaaccggauccugtt

SEQ ID NO: 1319 - DNA, 21 bp, Artificial
  siRNA construct
cagucaaaccggauccuggtt

SEQ ID NO: 1320 - DNA, 21 bp, Artificial
  siRNA construct
agucaaaccggauccugggtt

SEQ ID NO: 1321 - DNA, 21 bp, Artificial
  siRNA construct
gggugaagagaaagauccctt

SEQ ID NO: 1322 - DNA, 21 bp, Artificial
  siRNA construct
cccugaugcugaacgacagtt

SEQ ID NO: 1323 - DNA, 21 bp, Artificial
  siRNA construct
ccugaugcugaacgacagutt

SEQ ID NO: 1324 - DNA, 21 bp, Artificial
  siRNA construct
cugaugcugaacgacagugtt

SEQ ID NO: 1325 - DNA, 21 bp, Artificial
  siRNA construct
ugaugcugaacgacaguggtt

SEQ ID NO: 1326 - DNA, 21 bp, Artificial
  siRNA construct
gaugcugaacgacaguggctt

SEQ ID NO: 1327 - DNA, 21 bp, Artificial
  siRNA construct
augcugaacgacaguggcutt

SEQ ID NO: 1328 - DNA, 21 bp, Artificial
  siRNA construct
ugcugaacgacaguggcuctt

SEQ ID NO: 1329 - DNA, 21 bp, Artificial
  siRNA construct
gcugaacgacaguggcucatt

SEQ ID NO: 1330 - DNA, 21 bp, Artificial
  siRNA construct
cugaacgacaguggcucagtt

SEQ ID NO: 1331 - DNA, 21 bp, Artificial
  siRNA construct
ugaacgacaguggcucagctt

SEQ ID NO: 1332 - DNA, 21 bp, Artificial
  siRNA construct
gaacgacaguggcucagcatt

SEQ ID NO: 1333 - DNA, 21 bp, Artificial
  siRNA construct
aacgacaguggcucagcactt

SEQ ID NO: 1334 - DNA, 21 bp, Artificial
  siRNA construct
acgacaguggcucagcacatt

SEQ ID NO: 1335 - DNA, 21 bp, Artificial
  siRNA construct
cgacaguggcucagcacautt

SEQ ID NO: 1336 - DNA, 21 bp, Artificial
  siRNA construct
gacaguggcucagcacauutt

SEQ ID NO: 1337 - DNA, 21 bp, Artificial
  siRNA construct
acaguggcucagcacauuctt

SEQ ID NO: 1338 - DNA, 21 bp, Artificial
  siRNA construct
caguggcucagcacauucctt

SEQ ID NO: 1339 - DNA, 21 bp, Artificial
  siRNA construct
aguggcucagcacauuccatt

SEQ ID NO: 1340 - DNA, 21 bp, Artificial
  siRNA construct
guggcucagcacauuccautt

SEQ ID NO: 1341 - DNA, 21 bp, Artificial
  siRNA construct
uggcucagcacauuccaugtt

SEQ ID NO: 1342 - DNA, 21 bp, Artificial
  siRNA construct
ggcucagcacauuccaugctt

SEQ ID NO: 1343 - DNA, 21 bp, Artificial
  siRNA construct
gcucagcacauuccaugcctt

SEQ ID NO: 1344 - DNA, 21 bp, Artificial
  siRNA construct
cucagcacauuccaugccctt

SEQ ID NO: 1345 - DNA, 21 bp, Artificial
  siRNA construct
ucagcacauuccaugcccatt

SEQ ID NO: 1346 - DNA, 21 bp, Artificial
  siRNA construct
cagcacauuccaugcccaatt

SEQ ID NO: 1347 - DNA, 21 bp, Artificial
  siRNA construct
agcacauuccaugcccaagtt

SEQ ID NO: 1348 - DNA, 21 bp, Artificial
  siRNA construct
gcacauuccaugcccaagutt

SEQ ID NO: 1349 - DNA, 21 bp, Artificial
  siRNA construct
cacauuccaugcccaaguatt

SEQ ID NO: 1350 - DNA, 21 bp, Artificial
  siRNA construct
acauuccaugcccaaguautt

SEQ ID NO: 1351 - DNA, 21 bp, Artificial
  siRNA construct
gccggcaguucucccuggatt

SEQ ID NO: 1352 - DNA, 21 bp, Artificial
  siRNA construct
ccggcaguucucccuggagtt

SEQ ID NO: 1353 - DNA, 21 bp, Artificial
  siRNA construct
cggcaguucucccuggagctt

SEQ ID NO: 1354 - DNA, 21 bp, Artificial
  siRNA construct
ggcaguucucccuggagcatt

SEQ ID NO: 1355 - DNA, 21 bp, Artificial
  siRNA construct
gcaguucucccuggagcactt

SEQ ID NO: 1356 - DNA, 21 bp, Artificial
  siRNA construct
caguucucccuggagcacgtt

SEQ ID NO: 1357 - DNA, 21 bp, Artificial
  siRNA construct
aguucucccuggagcacgutt

SEQ ID NO: 1358 - DNA, 21 bp, Artificial
  siRNA construct
guucucccuggagcacguctt

SEQ ID NO: 1359 - DNA, 21 bp, Artificial
  siRNA construct
uucucccuggagcacgucctt

SEQ ID NO: 1360 - DNA, 21 bp, Artificial
  siRNA construct
ucucccuggagcacguccatt

SEQ ID NO: 1361 - DNA, 21 bp, Artificial
  siRNA construct
cucccuggagcacguccactt

SEQ ID NO: 1362 - DNA, 21 bp, Artificial
  siRNA construct
ucccuggagcacguccacgtt

SEQ ID NO: 1363 - DNA, 21 bp, Artificial
  siRNA construct
cccuggagcacguccacggtt

SEQ ID NO: 1364 - DNA, 21 bp, Artificial
  siRNA construct
ccuggagcacguccacggctt

SEQ ID NO: 1365 - DNA, 21 bp, Artificial
  siRNA construct
cuggagcacguccacggcutt

SEQ ID NO: 1366 - DNA, 21 bp, Artificial
  siRNA construct
uggagcacguccacggcuctt

SEQ ID NO: 1367 - DNA, 21 bp, Artificial
  siRNA construct
ggagcacguccacggcucgtt

SEQ ID NO: 1368 - DNA, 21 bp, Artificial
  siRNA construct
gagcacguccacggcucggtt

SEQ ID NO: 1369 - DNA, 21 bp, Artificial
  siRNA construct
agcacguccacggcucgggtt

SEQ ID NO: 1370 - DNA, 21 bp, Artificial
  siRNA construct
gcacguccacggcucgggctt

SEQ ID NO: 1371 - DNA, 21 bp, Artificial
  siRNA construct
cacguccacggcucgggcctt

SEQ ID NO: 1372 - DNA, 21 bp, Artificial
  siRNA construct
acguccacggcucgggccctt

SEQ ID NO: 1373 - DNA, 21 bp, Artificial
  siRNA construct
agcuccagccucuacgccctt

SEQ ID NO: 1374 - DNA, 21 bp, Artificial
  siRNA construct
ggacccaucaucuccgacatt

SEQ ID NO: 1375 - DNA, 21 bp, Artificial
  siRNA construct
gacccaucaucuccgacautt

SEQ ID NO: 1376 - DNA, 21 bp, Artificial
  siRNA construct
acccaucaucuccgacauctt

SEQ ID NO: 1377 - DNA, 21 bp, Artificial
  siRNA construct
cccaucaucuccgacaucatt

SEQ ID NO: 1378 - DNA, 21 bp, Artificial
  siRNA construct
ccaucaucuccgacaucactt

SEQ ID NO: 1379 - DNA, 21 bp, Artificial
  siRNA construct
caucaucuccgacaucacctt

SEQ ID NO: 1380 - DNA, 21 bp, Artificial
  siRNA construct
aucaucuccgacaucaccgtt

SEQ ID NO: 1381 - DNA, 21 bp, Artificial
  siRNA construct
ucaucuccgacaucaccgatt

SEQ ID NO: 1382 - DNA, 21 bp, Artificial
  siRNA construct
caucuccgacaucaccgagtt

SEQ ID NO: 1383 - DNA, 21 bp, Artificial
  siRNA construct
aucuccgacaucaccgagctt

SEQ ID NO: 1384 - DNA, 21 bp, Artificial
  siRNA construct
ucuccgacaucaccgagcutt

SEQ ID NO: 1385 - DNA, 21 bp, Artificial
  siRNA construct
cuccgacaucaccgagcugtt

SEQ ID NO: 1386 - DNA, 21 bp, Artificial
  siRNA construct
uccgacaucaccgagcuggtt

SEQ ID NO: 1387 - DNA, 21 bp, Artificial
  siRNA construct
ccgacaucaccgagcuggctt

SEQ ID NO: 1388 - DNA, 21 bp, Artificial
  siRNA construct
cgacaucaccgagcuggcutt

SEQ ID NO: 1389 - DNA, 21 bp, Artificial
  siRNA construct
gacaucaccgagcuggcuctt

SEQ ID NO: 1390 - DNA, 21 bp, Artificial
  siRNA construct
acaucaccgagcuggcucctt

SEQ ID NO: 1391 - DNA, 21 bp, Artificial
  siRNA construct
caucaccgagcuggcuccutt

SEQ ID NO: 1392 - DNA, 21 bp, Artificial
  siRNA construct
aucaccgagcuggcuccugtt

SEQ ID NO: 1393 - DNA, 21 bp, Artificial
  siRNA construct
ucaccgagcuggcuccugctt

SEQ ID NO: 1394 - DNA, 21 bp, Artificial
  siRNA construct
caccgagcuggcuccugcctt

SEQ ID NO: 1395 - DNA, 21 bp, Artificial
  siRNA construct
accgagcuggcuccugccatt

SEQ ID NO: 1396 - DNA, 21 bp, Artificial
  siRNA construct
ccgagcuggcuccugccagtt

SEQ ID NO: 1397 - DNA, 21 bp, Artificial
  siRNA construct
cgagcuggcuccugccagctt

SEQ ID NO: 1398 - DNA, 21 bp, Artificial
  siRNA construct
gagcuggcuccugccagcctt

SEQ ID NO: 1399 - DNA, 21 bp, Artificial
  siRNA construct
agcuggcuccugccagccctt

SEQ ID NO: 1400 - DNA, 21 bp, Artificial
  siRNA construct
ggcgggagcauagacgagatt

SEQ ID NO: 1401 - DNA, 21 bp, Artificial
  siRNA construct
gcgggagcauagacgagagtt

SEQ ID NO: 1402 - DNA, 21 bp, Artificial
  siRNA construct
cgggagcauagacgagaggtt

SEQ ID NO: 1403 - DNA, 21 bp, Artificial
  siRNA construct
gggagcauagacgagaggctt

SEQ ID NO: 1404 - DNA, 21 bp, Artificial
  siRNA construct
ggagcauagacgagaggcctt

SEQ ID NO: 1405 - DNA, 21 bp, Artificial
  siRNA construct
gagcauagacgagaggccctt

SEQ ID NO: 1406 - DNA, 21 bp, Artificial
  siRNA construct
cccuggugcgugucaaggatt

SEQ ID NO: 1407 - DNA, 21 bp, Artificial
  siRNA construct
ccuggugcgugucaaggagtt

SEQ ID NO: 1408 - DNA, 21 bp, Artificial
  siRNA construct
cuggugcgugucaaggaggtt

SEQ ID NO: 1409 - DNA, 21 bp, Artificial
  siRNA construct
uggugcgugucaaggaggatt

SEQ ID NO: 1410 - DNA, 21 bp, Artificial
  siRNA construct
ggugcgugucaaggaggagtt

SEQ ID NO: 1411 - DNA, 21 bp, Artificial
  siRNA construct
gugcgugucaaggaggagctt

SEQ ID NO: 1412 - DNA, 21 bp, Artificial
  siRNA construct
ugcgugucaaggaggagcctt

SEQ ID NO: 1413 - DNA, 21 bp, Artificial
  siRNA construct
gcgugucaaggaggagccctt

SEQ ID NO: 1414 - DNA, 21 bp, Artificial
  siRNA construct
cccagcccgccucagagcctt

SEQ ID NO: 1415 - DNA, 21 bp, Artificial
  siRNA construct
ccagcccgccucagagccctt

SEQ ID NO: 1416 - DNA, 21 bp, Artificial
  siRNA construct
cacuuggaugcuauggacutt

SEQ ID NO: 1417 - DNA, 21 bp, Artificial
  siRNA construct
acuuggaugcuauggacuctt

SEQ ID NO: 1418 - DNA, 21 bp, Artificial
  siRNA construct
uuggaugcuauggacuccatt

SEQ ID NO: 1419 - DNA, 21 bp, Artificial
  siRNA construct
uggaugcuauggacuccaatt

SEQ ID NO: 1420 - DNA, 21 bp, Artificial
  siRNA construct
ggaugcuauggacuccaactt

SEQ ID NO: 1421 - DNA, 21 bp, Artificial
  siRNA construct
gaugcuauggacuccaacctt

SEQ ID NO: 1422 - DNA, 21 bp, Artificial
  siRNA construct
augcuauggacuccaaccutt

SEQ ID NO: 1423 - DNA, 21 bp, Artificial
  siRNA construct
ugcuauggacuccaaccugtt

SEQ ID NO: 1424 - DNA, 21 bp, Artificial
  siRNA construct
gcuauggacuccaaccuggtt

SEQ ID NO: 1425 - DNA, 21 bp, Artificial
  siRNA construct
cuauggacuccaaccuggatt

SEQ ID NO: 1426 - DNA, 21 bp, Artificial
  siRNA construct
aaccugcagaccaugcugatt

SEQ ID NO: 1427 - DNA, 21 bp, Artificial
  siRNA construct
accugcagaccaugcugagtt

SEQ ID NO: 1428 - DNA, 21 bp, Artificial
  siRNA construct
ccugcagaccaugcugagctt

SEQ ID NO: 1429 - DNA, 21 bp, Artificial
  siRNA construct
cugcagaccaugcugagcatt

SEQ ID NO: 1430 - DNA, 21 bp, Artificial
  siRNA construct
ugcagaccaugcugagcagtt

SEQ ID NO: 1431 - DNA, 21 bp, Artificial
  siRNA construct
gcagaccaugcugagcagctt

SEQ ID NO: 1432 - DNA, 21 bp, Artificial
  siRNA construct
cagaccaugcugagcagcctt

SEQ ID NO: 1433 - DNA, 21 bp, Artificial
  siRNA construct
agaccaugcugagcagccatt

SEQ ID NO: 1434 - DNA, 21 bp, Artificial
  siRNA construct
gaccaugcugagcagccactt

SEQ ID NO: 1435 - DNA, 21 bp, Artificial
  siRNA construct
accaugcugagcagccacgtt

SEQ ID NO: 1436 - DNA, 21 bp, Artificial
  siRNA construct
ccaugcugagcagccacggtt

SEQ ID NO: 1437 - DNA, 21 bp, Artificial
  siRNA construct
caugcugagcagccacggctt

SEQ ID NO: 1438 - DNA, 21 bp, Artificial
  siRNA construct
augcugagcagccacggcutt

SEQ ID NO: 1439 - DNA, 21 bp, Artificial
  siRNA construct
ugcugagcagccacggcuutt

SEQ ID NO: 1440 - DNA, 21 bp, Artificial
  siRNA construct
gcugagcagccacggcuuctt

SEQ ID NO: 1441 - DNA, 21 bp, Artificial
  siRNA construct
cugagcagccacggcuucatt

SEQ ID NO: 1442 - DNA, 21 bp, Artificial
  siRNA construct
ugagcagccacggcuucagtt

SEQ ID NO: 1443 - DNA, 21 bp, Artificial
  siRNA construct
gagcagccacggcuucagctt

SEQ ID NO: 1444 - DNA, 21 bp, Artificial
  siRNA construct
agcagccacggcuucagcgtt

SEQ ID NO: 1445 - DNA, 21 bp, Artificial
  siRNA construct
gcagccacggcuucagcgutt

SEQ ID NO: 1446 - DNA, 21 bp, Artificial
  siRNA construct
cagccacggcuucagcgugtt

SEQ ID NO: 1447 - DNA, 21 bp, Artificial
  siRNA construct
agccacggcuucagcguggtt

SEQ ID NO: 1448 - DNA, 21 bp, Artificial
  siRNA construct
gccacggcuucagcguggatt

SEQ ID NO: 1449 - DNA, 21 bp, Artificial
  siRNA construct
ccacggcuucagcguggactt

SEQ ID NO: 1450 - DNA, 21 bp, Artificial
  siRNA construct
cacggcuucagcguggacatt

SEQ ID NO: 1451 - DNA, 21 bp, Artificial
  siRNA construct
acggcuucagcguggacactt

SEQ ID NO: 1452 - DNA, 21 bp, Artificial
  siRNA construct
cggcuucagcguggacacctt

SEQ ID NO: 1453 - DNA, 21 bp, Artificial
  siRNA construct
ggcuucagcguggacaccatt

SEQ ID NO: 1454 - DNA, 21 bp, Artificial
  siRNA construct
gcuucagcguggacaccagtt

SEQ ID NO: 1455 - DNA, 21 bp, Artificial
  siRNA construct
gcccugcuggaccuguucatt

SEQ ID NO: 1456 - DNA, 21 bp, Artificial
  siRNA construct
cccugcuggaccuguucagtt

SEQ ID NO: 1457 - DNA, 21 bp, Artificial
  siRNA construct
ccugcuggaccuguucagctt

SEQ ID NO: 1458 - DNA, 21 bp, Artificial
  siRNA construct
cugcuggaccuguucagcctt

SEQ ID NO: 1459 - DNA, 21 bp, Artificial
  siRNA construct
ugcuggaccuguucagccctt

SEQ ID NO: 1460 - DNA, 21 bp, Artificial
  siRNA construct
cccucggugaccgugcccgtt

SEQ ID NO: 1461 - DNA, 21 bp, Artificial
  siRNA construct
ccucggugaccgugcccgatt

SEQ ID NO: 1462 - DNA, 21 bp, Artificial
  siRNA construct
cucggugaccgugcccgactt

SEQ ID NO: 1463 - DNA, 21 bp, Artificial
  siRNA construct
ucggugaccgugcccgacatt

SEQ ID NO: 1464 - DNA, 21 bp, Artificial
  siRNA construct
cggugaccgugcccgacautt

SEQ ID NO: 1465 - DNA, 21 bp, Artificial
  siRNA construct
ggugaccgugcccgacaugtt

SEQ ID NO: 1466 - DNA, 21 bp, Artificial
  siRNA construct
gugaccgugcccgacaugatt

SEQ ID NO: 1467 - DNA, 21 bp, Artificial
  siRNA construct
ugaccgugcccgacaugagtt

SEQ ID NO: 1468 - DNA, 21 bp, Artificial
  siRNA construct
gaccgugcccgacaugagctt

SEQ ID NO: 1469 - DNA, 21 bp, Artificial
  siRNA construct
accgugcccgacaugagcctt

SEQ ID NO: 1470 - DNA, 21 bp, Artificial
  siRNA construct
ccgugcccgacaugagccutt

SEQ ID NO: 1471 - DNA, 21 bp, Artificial
  siRNA construct
cgugcccgacaugagccugtt

SEQ ID NO: 1472 - DNA, 21 bp, Artificial
  siRNA construct
gugcccgacaugagccugctt

SEQ ID NO: 1473 - DNA, 21 bp, Artificial
  siRNA construct
ugcccgacaugagccugcctt

SEQ ID NO: 1474 - DNA, 21 bp, Artificial
  siRNA construct
gcccgacaugagccugccutt

SEQ ID NO: 1475 - DNA, 21 bp, Artificial
  siRNA construct
cccgacaugagccugccugtt

SEQ ID NO: 1476 - DNA, 21 bp, Artificial
  siRNA construct
ccgacaugagccugccugatt

SEQ ID NO: 1477 - DNA, 21 bp, Artificial
  siRNA construct
cgacaugagccugccugactt

SEQ ID NO: 1478 - DNA, 21 bp, Artificial
  siRNA construct
gacaugagccugccugacctt

SEQ ID NO: 1479 - DNA, 21 bp, Artificial
  siRNA construct
acaugagccugccugaccutt

SEQ ID NO: 1480 - DNA, 21 bp, Artificial
  siRNA construct
caugagccugccugaccuutt

SEQ ID NO: 1481 - DNA, 21 bp, Artificial
  siRNA construct
augagccugccugaccuugtt

SEQ ID NO: 1482 - DNA, 21 bp, Artificial
  siRNA construct
ugagccugccugaccuugatt

SEQ ID NO: 1483 - DNA, 21 bp, Artificial
  siRNA construct
gagccugccugaccuugactt

SEQ ID NO: 1484 - DNA, 21 bp, Artificial
  siRNA construct
agccugccugaccuugacatt

SEQ ID NO: 1485 - DNA, 21 bp, Artificial
  siRNA construct
gccugccugaccuugacagtt

SEQ ID NO: 1486 - DNA, 21 bp, Artificial
  siRNA construct
ccugccugaccuugacagctt

SEQ ID NO: 1487 - DNA, 21 bp, Artificial
  siRNA construct
cugccugaccuugacagcatt

SEQ ID NO: 1488 - DNA, 21 bp, Artificial
  siRNA construct
ugccugaccuugacagcagtt

SEQ ID NO: 1489 - DNA, 21 bp, Artificial
  siRNA construct
gccugaccuugacagcagctt

SEQ ID NO: 1490 - DNA, 21 bp, Artificial
  siRNA construct
ccugaccuugacagcagcctt

SEQ ID NO: 1491 - DNA, 21 bp, Artificial
  siRNA construct
cugaccuugacagcagccutt

SEQ ID NO: 1492 - DNA, 21 bp, Artificial
  siRNA construct
ugaccuugacagcagccugtt

SEQ ID NO: 1493 - DNA, 21 bp, Artificial
  siRNA construct
gaccuugacagcagccuggtt

SEQ ID NO: 1494 - DNA, 21 bp, Artificial
  siRNA construct
accuugacagcagccuggctt

SEQ ID NO: 1495 - DNA, 21 bp, Artificial
  siRNA construct
aguauccaagagcuccugutt

SEQ ID NO: 1496 - DNA, 21 bp, Artificial
  siRNA construct
guauccaagagcuccuguctt

SEQ ID NO: 1497 - DNA, 21 bp, Artificial
  siRNA construct
uauccaagagcuccugucutt

SEQ ID NO: 1498 - DNA, 21 bp, Artificial
  siRNA construct
auccaagagcuccugucuctt

SEQ ID NO: 1499 - DNA, 21 bp, Artificial
  siRNA construct
uccaagagcuccugucucctt

SEQ ID NO: 1500 - DNA, 21 bp, Artificial
  siRNA construct
ccaagagcuccugucuccctt

SEQ ID NO: 1501 - DNA, 21 bp, Artificial
  siRNA construct
gagaacagcagcccggauutt

SEQ ID NO: 1502 - DNA, 21 bp, Artificial
  siRNA construct
agaacagcagcccggauuctt

SEQ ID NO: 1503 - DNA, 21 bp, Artificial
  siRNA construct
gaacagcagcccggauucatt

SEQ ID NO: 1504 - DNA, 21 bp, Artificial
  siRNA construct
aacagcagcccggauucagtt

SEQ ID NO: 1505 - DNA, 21 bp, Artificial
  siRNA construct
acagcagcccggauucaggtt

SEQ ID NO: 1506 - DNA, 21 bp, Artificial
  siRNA construct
cagcagcccggauucagggtt

SEQ ID NO: 1507 - DNA, 21 bp, Artificial
  siRNA construct
agcagcccggauucagggatt

SEQ ID NO: 1508 - DNA, 21 bp, Artificial
  siRNA construct
gcagcccggauucagggaatt

SEQ ID NO: 1509 - DNA, 21 bp, Artificial
  siRNA construct
cagcccggauucagggaagtt

SEQ ID NO: 1510 - DNA, 21 bp, Artificial
  siRNA construct
agcccggauucagggaagctt

SEQ ID NO: 1511 - DNA, 21 bp, Artificial
  siRNA construct
gcccggauucagggaagcatt

SEQ ID NO: 1512 - DNA, 21 bp, Artificial
  siRNA construct
cccggauucagggaagcagtt

SEQ ID NO: 1513 - DNA, 21 bp, Artificial
  siRNA construct
ccggauucagggaagcagctt

SEQ ID NO: 1514 - DNA, 21 bp, Artificial
  siRNA construct
cggauucagggaagcagcutt

SEQ ID NO: 1515 - DNA, 21 bp, Artificial
  siRNA construct
ggauucagggaagcagcugtt

SEQ ID NO: 1516 - DNA, 21 bp, Artificial
  siRNA construct
gauucagggaagcagcuggtt

SEQ ID NO: 1517 - DNA, 21 bp, Artificial
  siRNA construct
auucagggaagcagcuggutt

SEQ ID NO: 1518 - DNA, 21 bp, Artificial
  siRNA construct
cccggcuccguggacaccgtt

SEQ ID NO: 1519 - DNA, 21 bp, Artificial
  siRNA construct
ccggcuccguggacaccggtt

SEQ ID NO: 1520 - DNA, 21 bp, Artificial
  siRNA construct
cggcuccguggacaccgggtt

SEQ ID NO: 1521 - DNA, 21 bp, Artificial
  siRNA construct
ggcuccguggacaccgggatt

SEQ ID NO: 1522 - DNA, 21 bp, Artificial
  siRNA construct
gcuccguggacaccgggagtt

SEQ ID NO: 1523 - DNA, 21 bp, Artificial
  siRNA construct
cuccguggacaccgggagctt

SEQ ID NO: 1524 - DNA, 21 bp, Artificial
  siRNA construct
uccguggacaccgggagcatt

SEQ ID NO: 1525 - DNA, 21 bp, Artificial
  siRNA construct
ugccggugcuguuugagcutt

SEQ ID NO: 1526 - DNA, 21 bp, Artificial
  siRNA construct
gccggugcuguuugagcugtt

SEQ ID NO: 1527 - DNA, 21 bp, Artificial
  siRNA construct
ccggugcuguuugagcuggtt

SEQ ID NO: 1528 - DNA, 21 bp, Artificial
  siRNA construct
cggugcuguuugagcugggtt

SEQ ID NO: 1529 - DNA, 21 bp, Artificial
  siRNA construct
cccaccaucucccugcugatt

SEQ ID NO: 1530 - DNA, 21 bp, Artificial
  siRNA construct
ccaccaucucccugcugactt

SEQ ID NO: 1531 - DNA, 21 bp, Artificial
  siRNA construct
caccaucucccugcugacatt

SEQ ID NO: 1532 - DNA, 21 bp, Artificial
  siRNA construct
gagccucccaaagccaaggtt

SEQ ID NO: 1533 - DNA, 21 bp, Artificial
  siRNA construct
agccucccaaagccaaggatt

SEQ ID NO: 1534 - DNA, 21 bp, Artificial
  siRNA construct
gccucccaaagccaaggactt

SEQ ID NO: 1535 - DNA, 21 bp, Artificial
  siRNA construct
ccucccaaagccaaggacctt

SEQ ID NO: 1536 - DNA, 21 bp, Artificial
  siRNA construct
cucccaaagccaaggaccctt

SEQ ID NO: 1537 - DNA, 21 bp, Artificial
  siRNA construct
ccgggacguugcugggccctt

SEQ ID NO: 1538 - DNA, 21 bp, Artificial
  siRNA construct
gccgggacguugcugggcctt

SEQ ID NO: 1539 - DNA, 21 bp, Artificial
  siRNA construct
ggccgggacguugcugggctt

SEQ ID NO: 1540 - DNA, 21 bp, Artificial
  siRNA construct
aggccgggacguugcugggtt

SEQ ID NO: 1541 - DNA, 21 bp, Artificial
  siRNA construct
aaggccgggacguugcuggtt

SEQ ID NO: 1542 - DNA, 21 bp, Artificial
  siRNA construct
gaaggccgggacguugcugtt

SEQ ID NO: 1543 - DNA, 21 bp, Artificial
  siRNA construct
ggaaggccgggacguugcutt

SEQ ID NO: 1544 - DNA, 21 bp, Artificial
  siRNA construct
aggaaggccgggacguugctt

SEQ ID NO: 1545 - DNA, 21 bp, Artificial
  siRNA construct
caggaaggccgggacguugtt

SEQ ID NO: 1546 - DNA, 21 bp, Artificial
  siRNA construct
aacgucccggccuuccugatt

SEQ ID NO: 1547 - DNA, 21 bp, Artificial
  siRNA construct
gucaggaaggccgggacgutt

SEQ ID NO: 1548 - DNA, 21 bp, Artificial
  siRNA construct
ggucaggaaggccgggacgtt

SEQ ID NO: 1549 - DNA, 21 bp, Artificial
  siRNA construct
uggucaggaaggccgggactt

SEQ ID NO: 1550 - DNA, 21 bp, Artificial
  siRNA construct
gcuuggucaggaaggccggtt

SEQ ID NO: 1551 - DNA, 21 bp, Artificial
  siRNA construct
agcuuggucaggaaggccgtt

SEQ ID NO: 1552 - DNA, 21 bp, Artificial
  siRNA construct
cagcuuggucaggaaggcctt

SEQ ID NO: 1553 - DNA, 21 bp, Artificial
  siRNA construct
acagcuuggucaggaaggctt

SEQ ID NO: 1554 - DNA, 21 bp, Artificial
  siRNA construct
cacagcuuggucaggaaggtt

SEQ ID NO: 1555 - DNA, 21 bp, Artificial
  siRNA construct
ccacagcuuggucaggaagtt

SEQ ID NO: 1556 - DNA, 21 bp, Artificial
  siRNA construct
uccacagcuuggucaggaatt

SEQ ID NO: 1557 - DNA, 21 bp, Artificial
  siRNA construct
guccacagcuuggucaggatt

SEQ ID NO: 1558 - DNA, 21 bp, Artificial
  siRNA construct
gguccacagcuuggucaggtt

SEQ ID NO: 1559 - DNA, 21 bp, Artificial
  siRNA construct
ggguccacagcuuggucagtt

SEQ ID NO: 1560 - DNA, 21 bp, Artificial
  siRNA construct
aggguccacagcuuggucatt

SEQ ID NO: 1561 - DNA, 21 bp, Artificial
  siRNA construct
gaggguccacagcuugguctt

SEQ ID NO: 1562 - DNA, 21 bp, Artificial
  siRNA construct
cgaggguccacagcuuggutt

SEQ ID NO: 1563 - DNA, 21 bp, Artificial
  siRNA construct
acgaggguccacagcuuggtt

SEQ ID NO: 1564 - DNA, 21 bp, Artificial
  siRNA construct
cacgaggguccacagcuugtt

SEQ ID NO: 1565 - DNA, 21 bp, Artificial
  siRNA construct
ucacgaggguccacagcuutt

SEQ ID NO: 1566 - DNA, 21 bp, Artificial
  siRNA construct
cucacgaggguccacagcutt

SEQ ID NO: 1567 - DNA, 21 bp, Artificial
  siRNA construct
gcucacgaggguccacagctt

SEQ ID NO: 1568 - DNA, 21 bp, Artificial
  siRNA construct
cgcucacgaggguccacagtt

SEQ ID NO: 1569 - DNA, 21 bp, Artificial
  siRNA construct
ucgcucacgaggguccacatt

SEQ ID NO: 1570 - DNA, 21 bp, Artificial
  siRNA construct
gucgcucacgaggguccactt

SEQ ID NO: 1571 - DNA, 21 bp, Artificial
  siRNA construct
ggucgcucacgaggguccatt

SEQ ID NO: 1572 - DNA, 21 bp, Artificial
  siRNA construct
gggucgcucacgagggucctt

SEQ ID NO: 1573 - DNA, 21 bp, Artificial
  siRNA construct
cgggucgcucacgaggguctt

SEQ ID NO: 1574 - DNA, 21 bp, Artificial
  siRNA construct
ccgggucgcucacgagggutt

SEQ ID NO: 1575 - DNA, 21 bp, Artificial
  siRNA construct
uccgggucgcucacgagggtt

SEQ ID NO: 1576 - DNA, 21 bp, Artificial
  siRNA construct
guccgggucgcucacgaggtt

SEQ ID NO: 1577 - DNA, 21 bp, Artificial
  siRNA construct
uguccgggucgcucacgagtt

SEQ ID NO: 1578 - DNA, 21 bp, Artificial
  siRNA construct
guguccgggucgcucacgatt

SEQ ID NO: 1579 - DNA, 21 bp, Artificial
  siRNA construct
gguguccgggucgcucacgtt

SEQ ID NO: 1580 - DNA, 21 bp, Artificial
  siRNA construct
cgguguccgggucgcucactt

SEQ ID NO: 1581 - DNA, 21 bp, Artificial
  siRNA construct
ucgguguccgggucgcucatt

SEQ ID NO: 1582 - DNA, 21 bp, Artificial
  siRNA construct
gucgguguccgggucgcuctt

SEQ ID NO: 1583 - DNA, 21 bp, Artificial
  siRNA construct
cgucgguguccgggucgcutt

SEQ ID NO: 1584 - DNA, 21 bp, Artificial
  siRNA construct
gcgucgguguccgggucgctt

SEQ ID NO: 1585 - DNA, 21 bp, Artificial
  siRNA construct
ucgggcuccagcagaugagtt

SEQ ID NO: 1586 - DNA, 21 bp, Artificial
  siRNA construct
cucgggcuccagcagaugatt

SEQ ID NO: 1587 - DNA, 21 bp, Artificial
  siRNA construct
acuggcccuggucgaacactt

SEQ ID NO: 1588 - DNA, 21 bp, Artificial
  siRNA construct
aacuggcccuggucgaacatt

SEQ ID NO: 1589 - DNA, 21 bp, Artificial
  siRNA construct
aaacuggcccuggucgaactt

SEQ ID NO: 1590 - DNA, 21 bp, Artificial
  siRNA construct
caaacuggcccuggucgaatt

SEQ ID NO: 1591 - DNA, 21 bp, Artificial
  siRNA construct
gcaaacuggcccuggucgatt

SEQ ID NO: 1592 - DNA, 21 bp, Artificial
  siRNA construct
ggcaaacuggcccuggucgtt

SEQ ID NO: 1593 - DNA, 21 bp, Artificial
  siRNA construct
uggcaaacuggcccugguctt

SEQ ID NO: 1594 - DNA, 21 bp, Artificial
  siRNA construct
uuggcaaacuggcccuggutt

SEQ ID NO: 1595 - DNA, 21 bp, Artificial
  siRNA construct
cuuggcaaacuggcccuggtt

SEQ ID NO: 1596 - DNA, 21 bp, Artificial
  siRNA construct
ccuuggcaaacuggcccugtt

SEQ ID NO: 1597 - DNA, 21 bp, Artificial
  siRNA construct
uccuuggcaaacuggcccutt

SEQ ID NO: 1598 - DNA, 21 bp, Artificial
  siRNA construct
cuccuuggcaaacuggccctt

SEQ ID NO: 1599 - DNA, 21 bp, Artificial
  siRNA construct
ccuccuuggcaaacuggcctt

SEQ ID NO: 1600 - DNA, 21 bp, Artificial
  siRNA construct
accuccuuggcaaacuggctt

SEQ ID NO: 1601 - DNA, 21 bp, Artificial
  siRNA construct
caccuccuuggcaaacuggtt

SEQ ID NO: 1602 - DNA, 21 bp, Artificial
  siRNA construct
gcaccuccuuggcaaacugtt

SEQ ID NO: 1603 - DNA, 21 bp, Artificial
  siRNA construct
agcaccuccuuggcaaacutt

SEQ ID NO: 1604 - DNA, 21 bp, Artificial
  siRNA construct
cagcaccuccuuggcaaactt

SEQ ID NO: 1605 - DNA, 21 bp, Artificial
  siRNA construct
gcagcaccuccuuggcaaatt

SEQ ID NO: 1606 - DNA, 21 bp, Artificial
  siRNA construct
ggcagcaccuccuuggcaatt

SEQ ID NO: 1607 - DNA, 21 bp, Artificial
  siRNA construct
gggcagcaccuccuuggcatt

SEQ ID NO: 1608 - DNA, 21 bp, Artificial
  siRNA construct
ugggcagcaccuccuuggctt

SEQ ID NO: 1609 - DNA, 21 bp, Artificial
  siRNA construct
uugggcagcaccuccuuggtt

SEQ ID NO: 1610 - DNA, 21 bp, Artificial
  siRNA construct
cuugggcagcaccuccuugtt

SEQ ID NO: 1611 - DNA, 21 bp, Artificial
  siRNA construct
acuugggcagcaccuccuutt

SEQ ID NO: 1612 - DNA, 21 bp, Artificial
  siRNA construct
uacuugggcagcaccuccutt

SEQ ID NO: 1613 - DNA, 21 bp, Artificial
  siRNA construct
ccauguuguugugcuugaatt

SEQ ID NO: 1614 - DNA, 21 bp, Artificial
  siRNA construct
gccauguuguugugcuugatt

SEQ ID NO: 1615 - DNA, 21 bp, Artificial
  siRNA construct
ggccauguuguugugcuugtt

SEQ ID NO: 1616 - DNA, 21 bp, Artificial
  siRNA construct
uggccauguuguugugcuutt

SEQ ID NO: 1617 - DNA, 21 bp, Artificial
  siRNA construct
cuggccauguuguugugcutt

SEQ ID NO: 1618 - DNA, 21 bp, Artificial
  siRNA construct
gcuggccauguuguugugctt

SEQ ID NO: 1619 - DNA, 21 bp, Artificial
  siRNA construct
agcuggccauguuguugugtt

SEQ ID NO: 1620 - DNA, 21 bp, Artificial
  siRNA construct
aagcuggccauguuguugutt

SEQ ID NO: 1621 - DNA, 21 bp, Artificial
  siRNA construct
cgaagcuggccauguuguutt

SEQ ID NO: 1622 - DNA, 21 bp, Artificial
  siRNA construct
acgaagcuggccauguugutt

SEQ ID NO: 1623 - DNA, 21 bp, Artificial
  siRNA construct
cacgaagcuggccauguugtt

SEQ ID NO: 1624 - DNA, 21 bp, Artificial
  siRNA construct
gcacgaagcuggccauguutt

SEQ ID NO: 1625 - DNA, 21 bp, Artificial
  siRNA construct
cgcacgaagcuggccaugutt

SEQ ID NO: 1626 - DNA, 21 bp, Artificial
  siRNA construct
ccgcacgaagcuggccaugtt

SEQ ID NO: 1627 - DNA, 21 bp, Artificial
  siRNA construct
gccgcacgaagcuggccautt

SEQ ID NO: 1628 - DNA, 21 bp, Artificial
  siRNA construct
ugccgcacgaagcuggccatt

SEQ ID NO: 1629 - DNA, 21 bp, Artificial
  siRNA construct
ucucucucuggcuugaccatt

SEQ ID NO: 1630 - DNA, 21 bp, Artificial
  siRNA construct
gucucucucuggcuugacctt

SEQ ID NO: 1631 - DNA, 21 bp, Artificial
  siRNA construct
cgucucucucuggcuugactt

SEQ ID NO: 1632 - DNA, 21 bp, Artificial
  siRNA construct
ucgucucucucuggcuugatt

SEQ ID NO: 1633 - DNA, 21 bp, Artificial
  siRNA construct
gucgucucucucuggcuugtt

SEQ ID NO: 1634 - DNA, 21 bp, Artificial
  siRNA construct
ugucgucucucucuggcuutt

SEQ ID NO: 1635 - DNA, 21 bp, Artificial
  siRNA construct
gugucgucucucucuggcutt

SEQ ID NO: 1636 - DNA, 21 bp, Artificial
  siRNA construct
cgugucgucucucucuggctt

SEQ ID NO: 1637 - DNA, 21 bp, Artificial
  siRNA construct
ccgugucgucucucucuggtt

SEQ ID NO: 1638 - DNA, 21 bp, Artificial
  siRNA construct
uccgugucgucucucucugtt

SEQ ID NO: 1639 - DNA, 21 bp, Artificial
  siRNA construct
cuccgugucgucucucucutt

SEQ ID NO: 1640 - DNA, 21 bp, Artificial
  siRNA construct
acuccgugucgucucucuctt

SEQ ID NO: 1641 - DNA, 21 bp, Artificial
  siRNA construct
aacuccgugucgucucucutt

SEQ ID NO: 1642 - DNA, 21 bp, Artificial
  siRNA construct
gaacuccgugucgucucuctt

SEQ ID NO: 1643 - DNA, 21 bp, Artificial
  siRNA construct
ggaacuccgugucgucucutt

SEQ ID NO: 1644 - DNA, 21 bp, Artificial
  siRNA construct
uggaacuccgugucgucuctt

SEQ ID NO: 1645 - DNA, 21 bp, Artificial
  siRNA construct
cuggaacuccgugucgucutt

SEQ ID NO: 1646 - DNA, 21 bp, Artificial
  siRNA construct
gcuggaacuccgugucguctt

SEQ ID NO: 1647 - DNA, 21 bp, Artificial
  siRNA construct
ugcuggaacuccgugucgutt

SEQ ID NO: 1648 - DNA, 21 bp, Artificial
  siRNA construct
gugcuggaacuccgugucgtt

SEQ ID NO: 1649 - DNA, 21 bp, Artificial
  siRNA construct
ggugcuggaacuccguguctt

SEQ ID NO: 1650 - DNA, 21 bp, Artificial
  siRNA construct
gggugcuggaacuccgugutt

SEQ ID NO: 1651 - DNA, 21 bp, Artificial
  siRNA construct
caaggagcugcuccuggcctt

SEQ ID NO: 1652 - DNA, 21 bp, Artificial
  siRNA construct
ucaaggagcugcuccuggctt

SEQ ID NO: 1653 - DNA, 21 bp, Artificial
  siRNA construct
cucaaggagcugcuccuggtt

SEQ ID NO: 1654 - DNA, 21 bp, Artificial
  siRNA construct
ucucaaggagcugcuccugtt

SEQ ID NO: 1655 - DNA, 21 bp, Artificial
  siRNA construct
uucucaaggagcugcuccutt

SEQ ID NO: 1656 - DNA, 21 bp, Artificial
  siRNA construct
guucucaaggagcugcucctt

SEQ ID NO: 1657 - DNA, 21 bp, Artificial
  siRNA construct
uguucucaaggagcugcuctt

SEQ ID NO: 1658 - DNA, 21 bp, Artificial
  siRNA construct
auguucucaaggagcugcutt

SEQ ID NO: 1659 - DNA, 21 bp, Artificial
  siRNA construct
gauguucucaaggagcugctt

SEQ ID NO: 1660 - DNA, 21 bp, Artificial
  siRNA construct
ugauguucucaaggagcugtt

SEQ ID NO: 1661 - DNA, 21 bp, Artificial
  siRNA construct
uugauguucucaaggagcutt

SEQ ID NO: 1662 - DNA, 21 bp, Artificial
  siRNA construct
cuugauguucucaaggagctt

SEQ ID NO: 1663 - DNA, 21 bp, Artificial
  siRNA construct
ucuugauguucucaaggagtt

SEQ ID NO: 1664 - DNA, 21 bp, Artificial
  siRNA construct
cucuugauguucucaaggatt

SEQ ID NO: 1665 - DNA, 21 bp, Artificial
  siRNA construct
ccucuugauguucucaaggtt

SEQ ID NO: 1666 - DNA, 21 bp, Artificial
  siRNA construct
uccucuugauguucucaagtt

SEQ ID NO: 1667 - DNA, 21 bp, Artificial
  siRNA construct
uuccucuugauguucucaatt

SEQ ID NO: 1668 - DNA, 21 bp, Artificial
  siRNA construct
uuuccucuugauguucucatt

SEQ ID NO: 1669 - DNA, 21 bp, Artificial
  siRNA construct
cuuuccucuugauguucuctt

SEQ ID NO: 1670 - DNA, 21 bp, Artificial
  siRNA construct
acuuuccucuugauguucutt

SEQ ID NO: 1671 - DNA, 21 bp, Artificial
  siRNA construct
cacuuuccucuugauguuctt

SEQ ID NO: 1672 - DNA, 21 bp, Artificial
  siRNA construct
ucacuuuccucuugauguutt

SEQ ID NO: 1673 - DNA, 21 bp, Artificial
  siRNA construct
gucacuuuccucuugaugutt

SEQ ID NO: 1674 - DNA, 21 bp, Artificial
  siRNA construct
ggucacuuuccucuugaugtt

SEQ ID NO: 1675 - DNA, 21 bp, Artificial
  siRNA construct
uggucacuuuccucuugautt

SEQ ID NO: 1676 - DNA, 21 bp, Artificial
  siRNA construct
cuggucacuuuccucuugatt

SEQ ID NO: 1677 - DNA, 21 bp, Artificial
  siRNA construct
acuggucacuuuccucuugtt

SEQ ID NO: 1678 - DNA, 21 bp, Artificial
  siRNA construct
cacuggucacuuuccucuutt

SEQ ID NO: 1679 - DNA, 21 bp, Artificial
  siRNA construct
cacacuggucacuuuccuctt

SEQ ID NO: 1680 - DNA, 21 bp, Artificial
  siRNA construct
acacacuggucacuuuccutt

SEQ ID NO: 1681 - DNA, 21 bp, Artificial
  siRNA construct
gacacacuggucacuuucctt

SEQ ID NO: 1682 - DNA, 21 bp, Artificial
  siRNA construct
ggacacacuggucacuuuctt

SEQ ID NO: 1683 - DNA, 21 bp, Artificial
  siRNA construct
uggacacacuggucacuuutt

SEQ ID NO: 1684 - DNA, 21 bp, Artificial
  siRNA construct
guggacacacuggucacuutt

SEQ ID NO: 1685 - DNA, 21 bp, Artificial
  siRNA construct
gguggacacacuggucacutt

SEQ ID NO: 1686 - DNA, 21 bp, Artificial
  siRNA construct
ggguggacacacuggucactt

SEQ ID NO: 1687 - DNA, 21 bp, Artificial
  siRNA construct
aggguggacacacuggucatt

SEQ ID NO: 1688 - DNA, 21 bp, Artificial
  siRNA construct
caggguggacacacugguctt

SEQ ID NO: 1689 - DNA, 21 bp, Artificial
  siRNA construct
ucaggguggacacacuggutt

SEQ ID NO: 1690 - DNA, 21 bp, Artificial
  siRNA construct
uucaggguggacacacuggtt

SEQ ID NO: 1691 - DNA, 21 bp, Artificial
  siRNA construct
cuucaggguggacacacugtt

SEQ ID NO: 1692 - DNA, 21 bp, Artificial
  siRNA construct
ucuucaggguggacacacutt

SEQ ID NO: 1693 - DNA, 21 bp, Artificial
  siRNA construct
cucuucaggguggacacactt

SEQ ID NO: 1694 - DNA, 21 bp, Artificial
  siRNA construct
acucuucaggguggacacatt

SEQ ID NO: 1695 - DNA, 21 bp, Artificial
  siRNA construct
cacucuucaggguggacactt

SEQ ID NO: 1696 - DNA, 21 bp, Artificial
  siRNA construct
ucacucuucaggguggacatt

SEQ ID NO: 1697 - DNA, 21 bp, Artificial
  siRNA construct
uucacucuucaggguggactt

SEQ ID NO: 1698 - DNA, 21 bp, Artificial
  siRNA construct
cuucacucuucaggguggatt

SEQ ID NO: 1699 - DNA, 21 bp, Artificial
  siRNA construct
ucuucacucuucaggguggtt

SEQ ID NO: 1700 - DNA, 21 bp, Artificial
  siRNA construct
gucuucacucuucagggugtt

SEQ ID NO: 1701 - DNA, 21 bp, Artificial
  siRNA construct
ugucuucacucuucagggutt

SEQ ID NO: 1702 - DNA, 21 bp, Artificial
  siRNA construct
augucuucacucuucagggtt

SEQ ID NO: 1703 - DNA, 21 bp, Artificial
  siRNA construct
uaugucuucacucuucaggtt

SEQ ID NO: 1704 - DNA, 21 bp, Artificial
  siRNA construct
uuaugucuucacucuucagtt

SEQ ID NO: 1705 - DNA, 21 bp, Artificial
  siRNA construct
uuuaugucuucacucuucatt

SEQ ID NO: 1706 - DNA, 21 bp, Artificial
  siRNA construct
cuuuaugucuucacucuuctt

SEQ ID NO: 1707 - DNA, 21 bp, Artificial
  siRNA construct
ucuuuaugucuucacucuutt

SEQ ID NO: 1708 - DNA, 21 bp, Artificial
  siRNA construct
aucuuuaugucuucacucutt

SEQ ID NO: 1709 - DNA, 21 bp, Artificial
  siRNA construct
gaucuuuaugucuucacuctt

SEQ ID NO: 1710 - DNA, 21 bp, Artificial
  siRNA construct
ggaucuuuaugucuucacutt

SEQ ID NO: 1711 - DNA, 21 bp, Artificial
  siRNA construct
cggaucuuuaugucuucactt

SEQ ID NO: 1712 - DNA, 21 bp, Artificial
  siRNA construct
ccgucagcagcuuggugactt

SEQ ID NO: 1713 - DNA, 21 bp, Artificial
  siRNA construct
uccgucagcagcuuggugatt

SEQ ID NO: 1714 - DNA, 21 bp, Artificial
  siRNA construct
guccgucagcagcuuggugtt

SEQ ID NO: 1715 - DNA, 21 bp, Artificial
  siRNA construct
cguccgucagcagcuuggutt

SEQ ID NO: 1716 - DNA, 21 bp, Artificial
  siRNA construct
acguccgucagcagcuuggtt

SEQ ID NO: 1717 - DNA, 21 bp, Artificial
  siRNA construct
cacguccgucagcagcuugtt

SEQ ID NO: 1718 - DNA, 21 bp, Artificial
  siRNA construct
gcacguccgucagcagcuutt

SEQ ID NO: 1719 - DNA, 21 bp, Artificial
  siRNA construct
ugcacguccgucagcagcutt

SEQ ID NO: 1720 - DNA, 21 bp, Artificial
  siRNA construct
cugcacguccgucagcagctt

SEQ ID NO: 1721 - DNA, 21 bp, Artificial
  siRNA construct
gcugcacguccgucagcagtt

SEQ ID NO: 1722 - DNA, 21 bp, Artificial
  siRNA construct
agcugcacguccgucagcatt

SEQ ID NO: 1723 - DNA, 21 bp, Artificial
  siRNA construct
cagcugcacguccgucagctt

SEQ ID NO: 1724 - DNA, 21 bp, Artificial
  siRNA construct
ucagcugcacguccgucagtt

SEQ ID NO: 1725 - DNA, 21 bp, Artificial
  siRNA construct
aucagcugcacguccgucatt

SEQ ID NO: 1726 - DNA, 21 bp, Artificial
  siRNA construct
caucagcugcacguccguctt

SEQ ID NO: 1727 - DNA, 21 bp, Artificial
  siRNA construct
ucaucagcugcacguccgutt

SEQ ID NO: 1728 - DNA, 21 bp, Artificial
  siRNA construct
uucaucagcugcacguccgtt

SEQ ID NO: 1729 - DNA, 21 bp, Artificial
  siRNA construct
cuucaucagcugcacgucctt

SEQ ID NO: 1730 - DNA, 21 bp, Artificial
  siRNA construct
ccuucaucagcugcacguctt

SEQ ID NO: 1731 - DNA, 21 bp, Artificial
  siRNA construct
cccuucaucagcugcacgutt

SEQ ID NO: 1732 - DNA, 21 bp, Artificial
  siRNA construct
gccacagagccucauucuctt

SEQ ID NO: 1733 - DNA, 21 bp, Artificial
  siRNA construct
cgccacagagccucauucutt

SEQ ID NO: 1734 - DNA, 21 bp, Artificial
  siRNA construct
ccgccacagagccucauuctt

SEQ ID NO: 1735 - DNA, 21 bp, Artificial
  siRNA construct
cccgccacagagccucauutt

SEQ ID NO: 1736 - DNA, 21 bp, Artificial
  siRNA construct
ucccgccacagagccucautt

SEQ ID NO: 1737 - DNA, 21 bp, Artificial
  siRNA construct
cucccgccacagagccucatt

SEQ ID NO: 1738 - DNA, 21 bp, Artificial
  siRNA construct
ccucccgccacagagccuctt

SEQ ID NO: 1739 - DNA, 21 bp, Artificial
  siRNA construct
accucccgccacagagccutt

SEQ ID NO: 1740 - DNA, 21 bp, Artificial
  siRNA construct
caccucccgccacagagcctt

SEQ ID NO: 1741 - DNA, 21 bp, Artificial
  siRNA construct
ccaccucccgccacagagctt

SEQ ID NO: 1742 - DNA, 21 bp, Artificial
  siRNA construct
gccaccucccgccacagagtt

SEQ ID NO: 1743 - DNA, 21 bp, Artificial
  siRNA construct
ggccaccucccgccacagatt

SEQ ID NO: 1744 - DNA, 21 bp, Artificial
  siRNA construct
uggccaccucccgccacagtt

SEQ ID NO: 1745 - DNA, 21 bp, Artificial
  siRNA construct
cuggccaccucccgccacatt

SEQ ID NO: 1746 - DNA, 21 bp, Artificial
  siRNA construct
gcuggccaccucccgccactt

SEQ ID NO: 1747 - DNA, 21 bp, Artificial
  siRNA construct
ggcuggccaccucccgccatt

SEQ ID NO: 1748 - DNA, 21 bp, Artificial
  siRNA construct
aggcuggccaccucccgcctt

SEQ ID NO: 1749 - DNA, 21 bp, Artificial
  siRNA construct
aaggcuggccaccucccgctt

SEQ ID NO: 1750 - DNA, 21 bp, Artificial
  siRNA construct
gaaggcuggccaccucccgtt

SEQ ID NO: 1751 - DNA, 21 bp, Artificial
  siRNA construct
cgaaggcuggccaccuccctt

SEQ ID NO: 1752 - DNA, 21 bp, Artificial
  siRNA construct
ccgaaggcuggccaccucctt

SEQ ID NO: 1753 - DNA, 21 bp, Artificial
  siRNA construct
gccgaaggcuggccaccuctt

SEQ ID NO: 1754 - DNA, 21 bp, Artificial
  siRNA construct
ugccgaaggcuggccaccutt

SEQ ID NO: 1755 - DNA, 21 bp, Artificial
  siRNA construct
cugccgaaggcuggccacctt

SEQ ID NO: 1756 - DNA, 21 bp, Artificial
  siRNA construct
ucugccgaaggcuggccactt

SEQ ID NO: 1757 - DNA, 21 bp, Artificial
  siRNA construct
uucugccgaaggcuggccatt

SEQ ID NO: 1758 - DNA, 21 bp, Artificial
  siRNA construct
cuucugccgaaggcuggcctt

SEQ ID NO: 1759 - DNA, 21 bp, Artificial
  siRNA construct
gcuucugccgaaggcuggctt

SEQ ID NO: 1760 - DNA, 21 bp, Artificial
  siRNA construct
ugcuucugccgaaggcuggtt

SEQ ID NO: 1761 - DNA, 21 bp, Artificial
  siRNA construct
augcuucugccgaaggcugtt

SEQ ID NO: 1762 - DNA, 21 bp, Artificial
  siRNA construct
caugcuucugccgaaggcutt

SEQ ID NO: 1763 - DNA, 21 bp, Artificial
  siRNA construct
gcaugcuucugccgaaggctt

SEQ ID NO: 1764 - DNA, 21 bp, Artificial
  siRNA construct
ggcaugcuucugccgaaggtt

SEQ ID NO: 1765 - DNA, 21 bp, Artificial
  siRNA construct
gggcaugcuucugccgaagtt

SEQ ID NO: 1766 - DNA, 21 bp, Artificial
  siRNA construct
ugggcaugcuucugccgaatt

SEQ ID NO: 1767 - DNA, 21 bp, Artificial
  siRNA construct
cugggcaugcuucugccgatt

SEQ ID NO: 1768 - DNA, 21 bp, Artificial
  siRNA construct
gcugggcaugcuucugccgtt

SEQ ID NO: 1769 - DNA, 21 bp, Artificial
  siRNA construct
ugcugggcaugcuucugcctt

SEQ ID NO: 1770 - DNA, 21 bp, Artificial
  siRNA construct
uugcugggcaugcuucugctt

SEQ ID NO: 1771 - DNA, 21 bp, Artificial
  siRNA construct
guugcugggcaugcuucugtt

SEQ ID NO: 1772 - DNA, 21 bp, Artificial
  siRNA construct
uguugcugggcaugcuucutt

SEQ ID NO: 1773 - DNA, 21 bp, Artificial
  siRNA construct
cuguugcugggcaugcuuctt

SEQ ID NO: 1774 - DNA, 21 bp, Artificial
  siRNA construct
ucuguugcugggcaugcuutt

SEQ ID NO: 1775 - DNA, 21 bp, Artificial
  siRNA construct
uucuguugcugggcaugcutt

SEQ ID NO: 1776 - DNA, 21 bp, Artificial
  siRNA construct
uuucuguugcugggcaugctt

SEQ ID NO: 1777 - DNA, 21 bp, Artificial
  siRNA construct
cuuucuguugcugggcaugtt

SEQ ID NO: 1778 - DNA, 21 bp, Artificial
  siRNA construct
acuuucuguugcugggcautt

SEQ ID NO: 1779 - DNA, 21 bp, Artificial
  siRNA construct
gacuuucuguugcugggcatt

SEQ ID NO: 1780 - DNA, 21 bp, Artificial
  siRNA construct
cgacuuucuguugcugggctt

SEQ ID NO: 1781 - DNA, 21 bp, Artificial
  siRNA construct
acgacuuucuguugcugggtt

SEQ ID NO: 1782 - DNA, 21 bp, Artificial
  siRNA construct
gacgacuuucuguugcuggtt

SEQ ID NO: 1783 - DNA, 21 bp, Artificial
  siRNA construct
ugacgacuuucuguugcugtt

SEQ ID NO: 1784 - DNA, 21 bp, Artificial
  siRNA construct
uugacgacuuucuguugcutt

SEQ ID NO: 1785 - DNA, 21 bp, Artificial
  siRNA construct
guugacgacuuucuguugctt

SEQ ID NO: 1786 - DNA, 21 bp, Artificial
  siRNA construct
uguugacgacuuucuguugtt

SEQ ID NO: 1787 - DNA, 21 bp, Artificial
  siRNA construct
uuguugacgacuuucuguutt

SEQ ID NO: 1788 - DNA, 21 bp, Artificial
  siRNA construct
cuuguugacgacuuucugutt

SEQ ID NO: 1789 - DNA, 21 bp, Artificial
  siRNA construct
gcuuguugacgacuuucugtt

SEQ ID NO: 1790 - DNA, 21 bp, Artificial
  siRNA construct
agcuuguugacgacuuucutt

SEQ ID NO: 1791 - DNA, 21 bp, Artificial
  siRNA construct
gagcuuguugacgacuuuctt

SEQ ID NO: 1792 - DNA, 21 bp, Artificial
  siRNA construct
ugagcuuguugacgacuuutt

SEQ ID NO: 1793 - DNA, 21 bp, Artificial
  siRNA construct
augagcuuguugacgacuutt

SEQ ID NO: 1794 - DNA, 21 bp, Artificial
  siRNA construct
aaugagcuuguugacgacutt

SEQ ID NO: 1795 - DNA, 21 bp, Artificial
  siRNA construct
gaaugagcuuguugacgactt

SEQ ID NO: 1796 - DNA, 21 bp, Artificial
  siRNA construct
ugaaugagcuuguugacgatt

SEQ ID NO: 1797 - DNA, 21 bp, Artificial
  siRNA construct
cugaaugagcuuguugacgtt

SEQ ID NO: 1798 - DNA, 21 bp, Artificial
  siRNA construct
acugaaugagcuuguugactt

SEQ ID NO: 1799 - DNA, 21 bp, Artificial
  siRNA construct
aacugaaugagcuuguugatt

SEQ ID NO: 1800 - DNA, 21 bp, Artificial
  siRNA construct
gaacugaaugagcuuguugtt

SEQ ID NO: 1801 - DNA, 21 bp, Artificial
  siRNA construct
ggaacugaaugagcuuguutt

SEQ ID NO: 1802 - DNA, 21 bp, Artificial
  siRNA construct
aggaacugaaugagcuugutt

SEQ ID NO: 1803 - DNA, 21 bp, Artificial
  siRNA construct
caggaacugaaugagcuugtt

SEQ ID NO: 1804 - DNA, 21 bp, Artificial
  siRNA construct
ucaggaacugaaugagcuutt

SEQ ID NO: 1805 - DNA, 21 bp, Artificial
  siRNA construct
aucaggaacugaaugagcutt

SEQ ID NO: 1806 - DNA, 21 bp, Artificial
  siRNA construct
gaucaggaacugaaugagctt

SEQ ID NO: 1807 - DNA, 21 bp, Artificial
  siRNA construct
agaucaggaacugaaugagtt

SEQ ID NO: 1808 - DNA, 21 bp, Artificial
  siRNA construct
gagaucaggaacugaaugatt

SEQ ID NO: 1809 - DNA, 21 bp, Artificial
  siRNA construct
ugagaucaggaacugaaugtt

SEQ ID NO: 1810 - DNA, 21 bp, Artificial
  siRNA construct
gugagaucaggaacugaautt

SEQ ID NO: 1811 - DNA, 21 bp, Artificial
  siRNA construct
agugagaucaggaacugaatt

SEQ ID NO: 1812 - DNA, 21 bp, Artificial
  siRNA construct
cagugagaucaggaacugatt

SEQ ID NO: 1813 - DNA, 21 bp, Artificial
  siRNA construct
ccagugagaucaggaacugtt

SEQ ID NO: 1814 - DNA, 21 bp, Artificial
  siRNA construct
accagugagaucaggaacutt

SEQ ID NO: 1815 - DNA, 21 bp, Artificial
  siRNA construct
gcaccagugagaucaggaatt

SEQ ID NO: 1816 - DNA, 21 bp, Artificial
  siRNA construct
ugcaccagugagaucaggatt

SEQ ID NO: 1817 - DNA, 21 bp, Artificial
  siRNA construct
cugcaccagugagaucaggtt

SEQ ID NO: 1818 - DNA, 21 bp, Artificial
  siRNA construct
gacugcaccagugagaucatt

SEQ ID NO: 1819 - DNA, 21 bp, Artificial
  siRNA construct
ugacugcaccagugagauctt

SEQ ID NO: 1820 - DNA, 21 bp, Artificial
  siRNA construct
uugacugcaccagugagautt

SEQ ID NO: 1821 - DNA, 21 bp, Artificial
  siRNA construct
uuugacugcaccagugagatt

SEQ ID NO: 1822 - DNA, 21 bp, Artificial
  siRNA construct
guuugacugcaccagugagtt

SEQ ID NO: 1823 - DNA, 21 bp, Artificial
  siRNA construct
cgguuugacugcaccagugtt

SEQ ID NO: 1824 - DNA, 21 bp, Artificial
  siRNA construct
ccgguuugacugcaccagutt

SEQ ID NO: 1825 - DNA, 21 bp, Artificial
  siRNA construct
uccgguuugacugcaccagtt

SEQ ID NO: 1826 - DNA, 21 bp, Artificial
  siRNA construct
auccgguuugacugcaccatt

SEQ ID NO: 1827 - DNA, 21 bp, Artificial
  siRNA construct
gauccgguuugacugcacctt

SEQ ID NO: 1828 - DNA, 21 bp, Artificial
  siRNA construct
ggauccgguuugacugcactt

SEQ ID NO: 1829 - DNA, 21 bp, Artificial
  siRNA construct
aggauccgguuugacugcatt

SEQ ID NO: 1830 - DNA, 21 bp, Artificial
  siRNA construct
caggauccgguuugacugctt

SEQ ID NO: 1831 - DNA, 21 bp, Artificial
  siRNA construct
ccaggauccgguuugacugtt

SEQ ID NO: 1832 - DNA, 21 bp, Artificial
  siRNA construct
cccaggauccgguuugacutt

SEQ ID NO: 1833 - DNA, 21 bp, Artificial
  siRNA construct
gggaucuuucucuucaccctt

SEQ ID NO: 1834 - DNA, 21 bp, Artificial
  siRNA construct
cugucguucagcaucagggtt

SEQ ID NO: 1835 - DNA, 21 bp, Artificial
  siRNA construct
acugucguucagcaucaggtt

SEQ ID NO: 1836 - DNA, 21 bp, Artificial
  siRNA construct
cacugucguucagcaucagtt

SEQ ID NO: 1837 - DNA, 21 bp, Artificial
  siRNA construct
ccacugucguucagcaucatt

SEQ ID NO: 1838 - DNA, 21 bp, Artificial
  siRNA construct
gccacugucguucagcauctt

SEQ ID NO: 1839 - DNA, 21 bp, Artificial
  siRNA construct
agccacugucguucagcautt

SEQ ID NO: 1840 - DNA, 21 bp, Artificial
  siRNA construct
gagccacugucguucagcatt

SEQ ID NO: 1841 - DNA, 21 bp, Artificial
  siRNA construct
ugagccacugucguucagctt

SEQ ID NO: 1842 - DNA, 21 bp, Artificial
  siRNA construct
cugagccacugucguucagtt

SEQ ID NO: 1843 - DNA, 21 bp, Artificial
  siRNA construct
gcugagccacugucguucatt

SEQ ID NO: 1844 - DNA, 21 bp, Artificial
  siRNA construct
ugcugagccacugucguuctt

SEQ ID NO: 1845 - DNA, 21 bp, Artificial
  siRNA construct
gugcugagccacugucguutt

SEQ ID NO: 1846 - DNA, 21 bp, Artificial
  siRNA construct
ugugcugagccacugucgutt

SEQ ID NO: 1847 - DNA, 21 bp, Artificial
  siRNA construct
augugcugagccacugucgtt

SEQ ID NO: 1848 - DNA, 21 bp, Artificial
  siRNA construct
aaugugcugagccacuguctt

SEQ ID NO: 1849 - DNA, 21 bp, Artificial
  siRNA construct
gaaugugcugagccacugutt

SEQ ID NO: 1850 - DNA, 21 bp, Artificial
  siRNA construct
ggaaugugcugagccacugtt

SEQ ID NO: 1851 - DNA, 21 bp, Artificial
  siRNA construct
uggaaugugcugagccacutt

SEQ ID NO: 1852 - DNA, 21 bp, Artificial
  siRNA construct
auggaaugugcugagccactt

SEQ ID NO: 1853 - DNA, 21 bp, Artificial
  siRNA construct
cauggaaugugcugagccatt

SEQ ID NO: 1854 - DNA, 21 bp, Artificial
  siRNA construct
gcauggaaugugcugagcctt

SEQ ID NO: 1855 - DNA, 21 bp, Artificial
  siRNA construct
ggcauggaaugugcugagctt

SEQ ID NO: 1856 - DNA, 21 bp, Artificial
  siRNA construct
gggcauggaaugugcugagtt

SEQ ID NO: 1857 - DNA, 21 bp, Artificial
  siRNA construct
ugggcauggaaugugcugatt

SEQ ID NO: 1858 - DNA, 21 bp, Artificial
  siRNA construct
uugggcauggaaugugcugtt

SEQ ID NO: 1859 - DNA, 21 bp, Artificial
  siRNA construct
cuugggcauggaaugugcutt

SEQ ID NO: 1860 - DNA, 21 bp, Artificial
  siRNA construct
acuugggcauggaaugugctt

SEQ ID NO: 1861 - DNA, 21 bp, Artificial
  siRNA construct
uacuugggcauggaaugugtt

SEQ ID NO: 1862 - DNA, 21 bp, Artificial
  siRNA construct
auacuugggcauggaaugutt

SEQ ID NO: 1863 - DNA, 21 bp, Artificial
  siRNA construct
uccagggagaacugccggctt

SEQ ID NO: 1864 - DNA, 21 bp, Artificial
  siRNA construct
cuccagggagaacugccggtt

SEQ ID NO: 1865 - DNA, 21 bp, Artificial
  siRNA construct
gcuccagggagaacugccgtt

SEQ ID NO: 1866 - DNA, 21 bp, Artificial
  siRNA construct
ugcuccagggagaacugcctt

SEQ ID NO: 1867 - DNA, 21 bp, Artificial
  siRNA construct
gugcuccagggagaacugctt

SEQ ID NO: 1868 - DNA, 21 bp, Artificial
  siRNA construct
cgugcuccagggagaacugtt

SEQ ID NO: 1869 - DNA, 21 bp, Artificial
  siRNA construct
acgugcuccagggagaacutt

SEQ ID NO: 1870 - DNA, 21 bp, Artificial
  siRNA construct
gacgugcuccagggagaactt

SEQ ID NO: 1871 - DNA, 21 bp, Artificial
  siRNA construct
ggacgugcuccagggagaatt

SEQ ID NO: 1872 - DNA, 21 bp, Artificial
  siRNA construct
uggacgugcuccagggagatt

SEQ ID NO: 1873 - DNA, 21 bp, Artificial
  siRNA construct
guggacgugcuccagggagtt

SEQ ID NO: 1874 - DNA, 21 bp, Artificial
  siRNA construct
cguggacgugcuccagggatt

SEQ ID NO: 1875 - DNA, 21 bp, Artificial
  siRNA construct
ccguggacgugcuccagggtt

SEQ ID NO: 1876 - DNA, 21 bp, Artificial
  siRNA construct
gccguggacgugcuccaggtt

SEQ ID NO: 1877 - DNA, 21 bp, Artificial
  siRNA construct
agccguggacgugcuccagtt

SEQ ID NO: 1878 - DNA, 21 bp, Artificial
  siRNA construct
gagccguggacgugcuccatt

SEQ ID NO: 1879 - DNA, 21 bp, Artificial
  siRNA construct
cgagccguggacgugcucctt

SEQ ID NO: 1880 - DNA, 21 bp, Artificial
  siRNA construct
ccgagccguggacgugcuctt

SEQ ID NO: 1881 - DNA, 21 bp, Artificial
  siRNA construct
cccgagccguggacgugcutt

SEQ ID NO: 1882 - DNA, 21 bp, Artificial
  siRNA construct
gcccgagccguggacgugctt

SEQ ID NO: 1883 - DNA, 21 bp, Artificial
  siRNA construct
ggcccgagccguggacgugtt

SEQ ID NO: 1884 - DNA, 21 bp, Artificial
  siRNA construct
gggcccgagccguggacgutt

SEQ ID NO: 1885 - DNA, 21 bp, Artificial
  siRNA construct
gggcguagaggcuggagcutt

SEQ ID NO: 1886 - DNA, 21 bp, Artificial
  siRNA construct
ugucggagaugaugggucctt

SEQ ID NO: 1887 - DNA, 21 bp, Artificial
  siRNA construct
augucggagaugauggguctt

SEQ ID NO: 1888 - DNA, 21 bp, Artificial
  siRNA construct
gaugucggagaugaugggutt

SEQ ID NO: 1889 - DNA, 21 bp, Artificial
  siRNA construct
ugaugucggagaugaugggtt

SEQ ID NO: 1890 - DNA, 21 bp, Artificial
  siRNA construct
gugaugucggagaugauggtt

SEQ ID NO: 1891 - DNA, 21 bp, Artificial
  siRNA construct
ggugaugucggagaugaugtt

SEQ ID NO: 1892 - DNA, 21 bp, Artificial
  siRNA construct
cggugaugucggagaugautt

SEQ ID NO: 1893 - DNA, 21 bp, Artificial
  siRNA construct
ucggugaugucggagaugatt

SEQ ID NO: 1894 - DNA, 21 bp, Artificial
  siRNA construct
cucggugaugucggagaugtt

SEQ ID NO: 1895 - DNA, 21 bp, Artificial
  siRNA construct
gcucggugaugucggagautt

SEQ ID NO: 1896 - DNA, 21 bp, Artificial
  siRNA construct
agcucggugaugucggagatt

SEQ ID NO: 1897 - DNA, 21 bp, Artificial
  siRNA construct
cagcucggugaugucggagtt

SEQ ID NO: 1898 - DNA, 21 bp, Artificial
  siRNA construct
ccagcucggugaugucggatt

SEQ ID NO: 1899 - DNA, 21 bp, Artificial
  siRNA construct
gccagcucggugaugucggtt

SEQ ID NO: 1900 - DNA, 21 bp, Artificial
  siRNA construct
agccagcucggugaugucgtt

SEQ ID NO: 1901 - DNA, 21 bp, Artificial
  siRNA construct
gagccagcucggugauguctt

SEQ ID NO: 1902 - DNA, 21 bp, Artificial
  siRNA construct
ggagccagcucggugaugutt

SEQ ID NO: 1903 - DNA, 21 bp, Artificial
  siRNA construct
aggagccagcucggugaugtt

SEQ ID NO: 1904 - DNA, 21 bp, Artificial
  siRNA construct
caggagccagcucggugautt

SEQ ID NO: 1905 - DNA, 21 bp, Artificial
  siRNA construct
gcaggagccagcucggugatt

SEQ ID NO: 1906 - DNA, 21 bp, Artificial
  siRNA construct
ggcaggagccagcucggugtt

SEQ ID NO: 1907 - DNA, 21 bp, Artificial
  siRNA construct
uggcaggagccagcucggutt

SEQ ID NO: 1908 - DNA, 21 bp, Artificial
  siRNA construct
cuggcaggagccagcucggtt

SEQ ID NO: 1909 - DNA, 21 bp, Artificial
  siRNA construct
gcuggcaggagccagcucgtt

SEQ ID NO: 1910 - DNA, 21 bp, Artificial
  siRNA construct
ggcuggcaggagccagcuctt

SEQ ID NO: 1911 - DNA, 21 bp, Artificial
  siRNA construct
gggcuggcaggagccagcutt

SEQ ID NO: 1912 - DNA, 21 bp, Artificial
  siRNA construct
ucucgucuaugcucccgcctt

SEQ ID NO: 1913 - DNA, 21 bp, Artificial
  siRNA construct
cucucgucuaugcucccgctt

SEQ ID NO: 1914 - DNA, 21 bp, Artificial
  siRNA construct
ccucucgucuaugcucccgtt

SEQ ID NO: 1915 - DNA, 21 bp, Artificial
  siRNA construct
gccucucgucuaugcuccctt

SEQ ID NO: 1916 - DNA, 21 bp, Artificial
  siRNA construct
ggccucucgucuaugcucctt

SEQ ID NO: 1917 - DNA, 21 bp, Artificial
  siRNA construct
gggccucucgucuaugcuctt

SEQ ID NO: 1918 - DNA, 21 bp, Artificial
  siRNA construct
uccuugacacgcaccagggtt

SEQ ID NO: 1919 - DNA, 21 bp, Artificial
  siRNA construct
cuccuugacacgcaccaggtt

SEQ ID NO: 1920 - DNA, 21 bp, Artificial
  siRNA construct
ccuccuugacacgcaccagtt

SEQ ID NO: 1921 - DNA, 21 bp, Artificial
  siRNA construct
uccuccuugacacgcaccatt

SEQ ID NO: 1922 - DNA, 21 bp, Artificial
  siRNA construct
cuccuccuugacacgcacctt

SEQ ID NO: 1923 - DNA, 21 bp, Artificial
  siRNA construct
gcuccuccuugacacgcactt

SEQ ID NO: 1924 - DNA, 21 bp, Artificial
  siRNA construct
ggcuccuccuugacacgcatt

SEQ ID NO: 1925 - DNA, 21 bp, Artificial
  siRNA construct
gggcuccuccuugacacgctt

SEQ ID NO: 1926 - DNA, 21 bp, Artificial
  siRNA construct
ggcucugaggcgggcugggtt

SEQ ID NO: 1927 - DNA, 21 bp, Artificial
  siRNA construct
gggcucugaggcgggcuggtt

SEQ ID NO: 1928 - DNA, 21 bp, Artificial
  siRNA construct
aguccauagcauccaagugtt

SEQ ID NO: 1929 - DNA, 21 bp, Artificial
  siRNA construct
gaguccauagcauccaagutt

SEQ ID NO: 1930 - DNA, 21 bp, Artificial
  siRNA construct
uggaguccauagcauccaatt

SEQ ID NO: 1931 - DNA, 21 bp, Artificial
  siRNA construct
uuggaguccauagcauccatt

SEQ ID NO: 1932 - DNA, 21 bp, Artificial
  siRNA construct
guuggaguccauagcaucctt

SEQ ID NO: 1933 - DNA, 21 bp, Artificial
  siRNA construct
gguuggaguccauagcauctt

SEQ ID NO: 1934 - DNA, 21 bp, Artificial
  siRNA construct
agguuggaguccauagcautt

SEQ ID NO: 1935 - DNA, 21 bp, Artificial
  siRNA construct
cagguuggaguccauagcatt

SEQ ID NO: 1936 - DNA, 21 bp, Artificial
  siRNA construct
ccagguuggaguccauagctt

SEQ ID NO: 1937 - DNA, 21 bp, Artificial
  siRNA construct
uccagguuggaguccauagtt

SEQ ID NO: 1938 - DNA, 21 bp, Artificial
  siRNA construct
ucagcauggucugcagguutt

SEQ ID NO: 1939 - DNA, 21 bp, Artificial
  siRNA construct
cucagcauggucugcaggutt

SEQ ID NO: 1940 - DNA, 21 bp, Artificial
  siRNA construct
gcucagcauggucugcaggtt

SEQ ID NO: 1941 - DNA, 21 bp, Artificial
  siRNA construct
ugcucagcauggucugcagtt

SEQ ID NO: 1942 - DNA, 21 bp, Artificial
  siRNA construct
cugcucagcauggucugcatt

SEQ ID NO: 1943 - DNA, 21 bp, Artificial
  siRNA construct
gcugcucagcauggucugctt

SEQ ID NO: 1944 - DNA, 21 bp, Artificial
  siRNA construct
ggcugcucagcauggucugtt

SEQ ID NO: 1945 - DNA, 21 bp, Artificial
  siRNA construct
uggcugcucagcauggucutt

SEQ ID NO: 1946 - DNA, 21 bp, Artificial
  siRNA construct
guggcugcucagcaugguctt

SEQ ID NO: 1947 - DNA, 21 bp, Artificial
  siRNA construct
cguggcugcucagcauggutt

SEQ ID NO: 1948 - DNA, 21 bp, Artificial
  siRNA construct
ccguggcugcucagcauggtt

SEQ ID NO: 1949 - DNA, 21 bp, Artificial
  siRNA construct
gccguggcugcucagcaugtt

SEQ ID NO: 1950 - DNA, 21 bp, Artificial
  siRNA construct
agccguggcugcucagcautt

SEQ ID NO: 1951 - DNA, 21 bp, Artificial
  siRNA construct
aagccguggcugcucagcatt

SEQ ID NO: 1952 - DNA, 21 bp, Artificial
  siRNA construct
gaagccguggcugcucagctt

SEQ ID NO: 1953 - DNA, 21 bp, Artificial
  siRNA construct
ugaagccguggcugcucagtt

SEQ ID NO: 1954 - DNA, 21 bp, Artificial
  siRNA construct
cugaagccguggcugcucatt

SEQ ID NO: 1955 - DNA, 21 bp, Artificial
  siRNA construct
gcugaagccguggcugcuctt

SEQ ID NO: 1956 - DNA, 21 bp, Artificial
  siRNA construct
cgcugaagccguggcugcutt

SEQ ID NO: 1957 - DNA, 21 bp, Artificial
  siRNA construct
acgcugaagccguggcugctt

SEQ ID NO: 1958 - DNA, 21 bp, Artificial
  siRNA construct
cacgcugaagccguggcugtt

SEQ ID NO: 1959 - DNA, 21 bp, Artificial
  siRNA construct
ccacgcugaagccguggcutt

SEQ ID NO: 1960 - DNA, 21 bp, Artificial
  siRNA construct
uccacgcugaagccguggctt

SEQ ID NO: 1961 - DNA, 21 bp, Artificial
  siRNA construct
guccacgcugaagccguggtt

SEQ ID NO: 1962 - DNA, 21 bp, Artificial
  siRNA construct
uguccacgcugaagccgugtt

SEQ ID NO: 1963 - DNA, 21 bp, Artificial
  siRNA construct
guguccacgcugaagccgutt

SEQ ID NO: 1964 - DNA, 21 bp, Artificial
  siRNA construct
gguguccacgcugaagccgtt

SEQ ID NO: 1965 - DNA, 21 bp, Artificial
  siRNA construct
ugguguccacgcugaagcctt

SEQ ID NO: 1966 - DNA, 21 bp, Artificial
  siRNA construct
cugguguccacgcugaagctt

SEQ ID NO: 1967 - DNA, 21 bp, Artificial
  siRNA construct
ugaacagguccagcagggctt

SEQ ID NO: 1968 - DNA, 21 bp, Artificial
  siRNA construct
cugaacagguccagcagggtt

SEQ ID NO: 1969 - DNA, 21 bp, Artificial
  siRNA construct
gcugaacagguccagcaggtt

SEQ ID NO: 1970 - DNA, 21 bp, Artificial
  siRNA construct
ggcugaacagguccagcagtt

SEQ ID NO: 1971 - DNA, 21 bp, Artificial
  siRNA construct
gggcugaacagguccagcatt

SEQ ID NO: 1972 - DNA, 21 bp, Artificial
  siRNA construct
cgggcacggucaccgagggtt

SEQ ID NO: 1973 - DNA, 21 bp, Artificial
  siRNA construct
ucgggcacggucaccgaggtt

SEQ ID NO: 1974 - DNA, 21 bp, Artificial
  siRNA construct
gucgggcacggucaccgagtt

SEQ ID NO: 1975 - DNA, 21 bp, Artificial
  siRNA construct
ugucgggcacggucaccgatt

SEQ ID NO: 1976 - DNA, 21 bp, Artificial
  siRNA construct
augucgggcacggucaccgtt

SEQ ID NO: 1977 - DNA, 21 bp, Artificial
  siRNA construct
caugucgggcacggucacctt

SEQ ID NO: 1978 - DNA, 21 bp, Artificial
  siRNA construct
ucaugucgggcacggucactt

SEQ ID NO: 1979 - DNA, 21 bp, Artificial
  siRNA construct
cucaugucgggcacggucatt

SEQ ID NO: 1980 - DNA, 21 bp, Artificial
  siRNA construct
gcucaugucgggcacgguctt

SEQ ID NO: 1981 - DNA, 21 bp, Artificial
  siRNA construct
ggcucaugucgggcacggutt

SEQ ID NO: 1982 - DNA, 21 bp, Artificial
  siRNA construct
aggcucaugucgggcacggtt

SEQ ID NO: 1983 - DNA, 21 bp, Artificial
  siRNA construct
caggcucaugucgggcacgtt

SEQ ID NO: 1984 - DNA, 21 bp, Artificial
  siRNA construct
gcaggcucaugucgggcactt

SEQ ID NO: 1985 - DNA, 21 bp, Artificial
  siRNA construct
ggcaggcucaugucgggcatt

SEQ ID NO: 1986 - DNA, 21 bp, Artificial
  siRNA construct
aggcaggcucaugucgggctt

SEQ ID NO: 1987 - DNA, 21 bp, Artificial
  siRNA construct
caggcaggcucaugucgggtt

SEQ ID NO: 1988 - DNA, 21 bp, Artificial
  siRNA construct
ucaggcaggcucaugucggtt

SEQ ID NO: 1989 - DNA, 21 bp, Artificial
  siRNA construct
gucaggcaggcucaugucgtt

SEQ ID NO: 1990 - DNA, 21 bp, Artificial
  siRNA construct
ggucaggcaggcucauguctt

SEQ ID NO: 1991 - DNA, 21 bp, Artificial
  siRNA construct
aggucaggcaggcucaugutt

SEQ ID NO: 1992 - DNA, 21 bp, Artificial
  siRNA construct
aaggucaggcaggcucaugtt

SEQ ID NO: 1993 - DNA, 21 bp, Artificial
  siRNA construct
caaggucaggcaggcucautt

SEQ ID NO: 1994 - DNA, 21 bp, Artificial
  siRNA construct
ucaaggucaggcaggcucatt

SEQ ID NO: 1995 - DNA, 21 bp, Artificial
  siRNA construct
gucaaggucaggcaggcuctt

SEQ ID NO: 1996 - DNA, 21 bp, Artificial
  siRNA construct
ugucaaggucaggcaggcutt

SEQ ID NO: 1997 - DNA, 21 bp, Artificial
  siRNA construct
cugucaaggucaggcaggctt

SEQ ID NO: 1998 - DNA, 21 bp, Artificial
  siRNA construct
gcugucaaggucaggcaggtt

SEQ ID NO: 1999 - DNA, 21 bp, Artificial
  siRNA construct
ugcugucaaggucaggcagtt

SEQ ID NO: 2000 - DNA, 21 bp, Artificial
  siRNA construct
cugcugucaaggucaggcatt

SEQ ID NO: 2001 - DNA, 21 bp, Artificial
  siRNA construct
gcugcugucaaggucaggctt

SEQ ID NO: 2002 - DNA, 21 bp, Artificial
  siRNA construct
ggcugcugucaaggucaggtt

SEQ ID NO: 2003 - DNA, 21 bp, Artificial
  siRNA construct
aggcugcugucaaggucagtt

SEQ ID NO: 2004 - DNA, 21 bp, Artificial
  siRNA construct
caggcugcugucaaggucatt

SEQ ID NO: 2005 - DNA, 21 bp, Artificial
  siRNA construct
ccaggcugcugucaagguctt

SEQ ID NO: 2006 - DNA, 21 bp, Artificial
  siRNA construct
gccaggcugcugucaaggutt

SEQ ID NO: 2007 - DNA, 21 bp, Artificial
  siRNA construct
acaggagcucuuggauacutt

SEQ ID NO: 2008 - DNA, 21 bp, Artificial
  siRNA construct
gacaggagcucuuggauactt

SEQ ID NO: 2009 - DNA, 21 bp, Artificial
  siRNA construct
agacaggagcucuuggauatt

SEQ ID NO: 2010 - DNA, 21 bp, Artificial
  siRNA construct
gagacaggagcucuuggautt

SEQ ID NO: 2011 - DNA, 21 bp, Artificial
  siRNA construct
ggagacaggagcucuuggatt

SEQ ID NO: 2012 - DNA, 21 bp, Artificial
  siRNA construct
gggagacaggagcucuuggtt

SEQ ID NO: 2013 - DNA, 21 bp, Artificial
  siRNA construct
aauccgggcugcuguucuctt

SEQ ID NO: 2014 - DNA, 21 bp, Artificial
  siRNA construct
gaauccgggcugcuguucutt

SEQ ID NO: 2015 - DNA, 21 bp, Artificial
  siRNA construct
ugaauccgggcugcuguuctt

SEQ ID NO: 2016 - DNA, 21 bp, Artificial
  siRNA construct
cugaauccgggcugcuguutt

SEQ ID NO: 2017 - DNA, 21 bp, Artificial
  siRNA construct
ccugaauccgggcugcugutt

SEQ ID NO: 2018 - DNA, 21 bp, Artificial
  siRNA construct
cccugaauccgggcugcugtt

SEQ ID NO: 2019 - DNA, 21 bp, Artificial
  siRNA construct
ucccugaauccgggcugcutt

SEQ ID NO: 2020 - DNA, 21 bp, Artificial
  siRNA construct
uucccugaauccgggcugctt

SEQ ID NO: 2021 - DNA, 21 bp, Artificial
  siRNA construct
cuucccugaauccgggcugtt

SEQ ID NO: 2022 - DNA, 21 bp, Artificial
  siRNA construct
gcuucccugaauccgggcutt

SEQ ID NO: 2023 - DNA, 21 bp, Artificial
  siRNA construct
ugcuucccugaauccgggctt

SEQ ID NO: 2024 - DNA, 21 bp, Artificial
  siRNA construct
cugcuucccugaauccgggtt

SEQ ID NO: 2025 - DNA, 21 bp, Artificial
  siRNA construct
gcugcuucccugaauccggtt

SEQ ID NO: 2026 - DNA, 21 bp, Artificial
  siRNA construct
agcugcuucccugaauccgtt

SEQ ID NO: 2027 - DNA, 21 bp, Artificial
  siRNA construct
cagcugcuucccugaaucctt

SEQ ID NO: 2028 - DNA, 21 bp, Artificial
  siRNA construct
ccagcugcuucccugaauctt

SEQ ID NO: 2029 - DNA, 21 bp, Artificial
  siRNA construct
accagcugcuucccugaautt

SEQ ID NO: 2030 - DNA, 21 bp, Artificial
  siRNA construct
cgguguccacggagccgggtt

SEQ ID NO: 2031 - DNA, 21 bp, Artificial
  siRNA construct
ccgguguccacggagccggtt

SEQ ID NO: 2032 - DNA, 21 bp, Artificial
  siRNA construct
cccgguguccacggagccgtt

SEQ ID NO: 2033 - DNA, 21 bp, Artificial
  siRNA construct
ucccgguguccacggagcctt

SEQ ID NO: 2034 - DNA, 21 bp, Artificial
  siRNA construct
cucccgguguccacggagctt

SEQ ID NO: 2035 - DNA, 21 bp, Artificial
  siRNA construct
gcucccgguguccacggagtt

SEQ ID NO: 2036 - DNA, 21 bp, Artificial
  siRNA construct
ugcucccgguguccacggatt

SEQ ID NO: 2037 - DNA, 21 bp, Artificial
  siRNA construct
agcucaaacagcaccggcatt

SEQ ID NO: 2038 - DNA, 21 bp, Artificial
  siRNA construct
cagcucaaacagcaccggctt

SEQ ID NO: 2039 - DNA, 21 bp, Artificial
  siRNA construct
ccagcucaaacagcaccggtt

SEQ ID NO: 2040 - DNA, 21 bp, Artificial
  siRNA construct
cccagcucaaacagcaccgtt

SEQ ID NO: 2041 - DNA, 21 bp, Artificial
  siRNA construct
ucagcagggagauggugggtt

SEQ ID NO: 2042 - DNA, 19 bp, Artificial
  siRNA construct
agaggaaagugaccagugu

SEQ ID NO: 2043 - DNA, 19 bp, Artificial
  siRNA construct
acacuggucacuuuccucu

SEQ ID NO: 2044 - DNA, 19 bp, Artificial
  siRNA construct
cugaucucacuggugcagu

SEQ ID NO: 2045 - DNA, 19 bp, Artificial
  siRNA construct
acugcaccagugagaucag

SEQ ID NO: 2046 - DNA, 21 bp, Artificial
  siRNA construct
agaggaaagugaccagugutt

SEQ ID NO: 2047 - DNA, 21 bp, Artificial
  siRNA construct
acacuggucacuuuccucutt

SEQ ID NO: 2048 - DNA, 21 bp, Artificial
  siRNA construct
cugaucucacuggugcagutt

SEQ ID NO: 2049 - DNA, 21 bp, Artificial
  siRNA construct
acugcaccagugagaucagtt

SEQ ID NO: 2050 - protein, 529 aa, Homo sapiens
MDLPVGPGAAGPSNVPAFLTKLWTLVSDPDTDALICWSPSGNSFHVFDQGQFAKEVLPKYFKHNNMASFVRQLNMYGFRKVVHIEQGGLVKPERDDTEFQHPCFLRGQEQLLENIKRKVTSVSTLKSEDIKIRQDSVTKLLTDVQLMKGKQECMDSKLLAMKHENEALWREVASLRQKHAQQQKVVNKLIQFLISLVQSNRILGVKRKIPLMLNDSGSAHSMPKYSRQFSLEHVHGSGPYSAPSPAYSSSSLYAPDAVASSGPIISDITELAPASPMASPGGSIDERPLSSSPLVRVKEEPPSPPQSPRVEEASPGRPSSVDTLLSPTALIDSILRESEPAPASVTALTDARGHTDTEGRPPSPPPTSTPEKCLSVACLDKNELSDHLDAMDSNLDNLQTMLSSHGFSVDTSALLDLFSPSVTVPDMSLPDLDSSLASIQELLSPQEPPRPPEAENSSPDSGKQLVHYTAQPLFLLDPGSVDTGSNDLPVLFELGEGSYFSEGDGFAEDPTISLLTGSEPPKAKDPTVS

SEQ ID NO: 2051 - DNA, 2166 bp, Homo sapiens
gcggcgggagcgcgcccgttgcaagatggcggcggccatgctgggccccggggctgtgtgtgcgcagcgggcggcggcgcggcccggaaggctggcgcggcgacggcgttagcccggccctcggcccctctttgcggccgctccctccgcctattccctccttgctcgagatggatctgcccgtgggccccggcgcggcggggcccagcaacgtcccggccttcctgaccaagctgtggaccctcgtgagcgacccggacaccgacgcgctcatctgctggagcccgagcgggaacagcttccacgtgttcgaccagggccagtttgccaaggaggtgctgcccaagtacttcaagcacaacaacatggccagcttcgtgcggcagctcaacatgtatggcttccggaaagtggtccacatcgagcagggcggcctggtcaagccagagagagacgacacggagttccagcacccatgcttcctgcgtggccaggagcagctccttgagaacatcaagaggaaagtgaccagtgtgtccaccctgaagagtgaagacataaagatccgccaggacagcgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatagccggcagttctccctggagcacgtccacggctcgggcccctactcggccccctccccagcctacagcagctccagcctctacgcccctgatgctgtggccagctctggacccatcatctccgacatcaccgagctggctcctgccagccccatggcctcccccggcgggagcatagacgagaggcccctatccagcagccccctggtgcgtgtcaaggaggagccccccagcccgcctcagagcccccgggtagaggaggcgagtcccgggcgcccatcttccgtggacaccctcttgtccccgaccgccctcattgactccatcctgcgggagagtgaacctgcccccgcctccgtcacagccctcacggacgccaggggccacacggacaccgagggccggcctccctcccccccgcccacctccacccctgaaaagtgcctcagcgtagcctgcctggacaagaatgagctcagtgaccacttggatgctatggactccaacctggataacctgcagaccatgctgagcagccacggcttcagcgtggacaccagtgccctgctggacctgttcagcccctcggtgaccgtgcccgacatgagcctgcctgaccttgacagcagcctggccagtatccaagagctcctgtctccccaggagccccccaggcctcccgaggcagagaacagcagcccggattcagggaagcagctggtgcactacacagcgcagccgctgttcctgctggaccccggctccgtggacaccgggagcaacgacctgccggtgctgtttgagctgggagagggctcctacttctccgaaggggacggcttcgccgaggaccccaccatctccctgctgacaggctcggagcctcccaaagccaaggaccccactgtctcctagaggccccggaggagctgggccagccgcccacccccacccccagtgcagggctggtcttggggaggcagggcagcctcgcggtcttgggcactggtgggtcggccgccatagccccagtaggacaaacgggctcgggtctgggcagcacctctggtcaggagggtcaccctggcctgccagtctgccttcccccaaccccgtgtcctgtggtttggttggggcttcacagccacacctggactgaccctgcaggttgttcatagtcagaattgtattttggatttttacacaactgtcccgttccccgctccacagagatacacagatatatacacacagtggatggacggacaagacaggcagagatctataaacagacaggctctatgctaaaaaaaaaaaaaaa

SEQ ID NO: 2052 - DNA, 2137 bp, Macaca fascicularis
  misc_feature (68)..(156): n is a, c, g, or t
  misc_feature (202)..(202): n is a, c, g, or t
  misc_feature (508)..(508): n is a, c, g, or t
cgcgcccgttgcaagatggcggcggcaaagctgggccttggggctgggggggcgcagggggaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagatggatctgcccgtgggccccggtgcggcggggcccagcaancgtcccggccttcctgaccaagctgtggaccctcgtgagcgacccggacaccgacgcgctcatctgctggagcccgagtgggaacagcttccatgtgttcgaccagggccagtttgccaaggaggtgctgcccaagtatttcaagcacaacaacatggccagcttcgtgcggcagctcaacatgtatggtttccggaaagtggtccacatcgagcagggtggcctggtcaagccagagagagacgacacggagttccagcacccgtgcttcctgcgcggccaggagcagctccttgagaacatcanagaggaaagtgaccagtgtgtccaccctgaagagtgaagacataaagatccgtcaggacagtgtcaccaagctgctgacggacgtgcagctgatgaaggggaagcaggagtgcatggactccaagctcctggccatgaagcatgagaatgaggctctgtggcgggaggtggccagccttcggcagaagcatgcccagcaacagaaagtcgtcaacaagctcattcagttcctgatctcactggtgcagtcaaaccggatcctgggggtgaagagaaagatccccctgatgctgaacgacagtggctcagcacattccatgcccaagtatggccggcagttctccctggagcacgtccacggctcgggcccctactcggccccctccccagcctacagtagctccagcctctacgcccccgattctgtggccaactccggacccatcatctccgacatcaccgagctggctcctgccagccccgtggcctcccctggcgggagcatagacgagaggcccctgtctagcagccccctggtgcgtgtcaaagaggagccccccagcccgcctcagagcccccgggtagaggaggcgagtcccgggcgcccatcttccgtggacaccctcttgtccccgaccgccctcattgactccatcctgcgggagagtgaacctacccccgcctccgccacagccctcaccgatgccaggggccacacggacaccgagggccggcctccctcacccccgcccacctccacccctgaaaagtgcctcagcgtagcctgcctggacaagaatgagctcagtgatcacttggatgctatggactccaacctggacaacctgcagaccatgctgagcagccacggcttcagcgtggacaccagcgccctgctggacctgttcagcccctcggtgaccgtgcccgacatgagcctgcctgaccttgacagcagcctggctagtatccaagagctcctgtctccccaggagccctccaggcctcccgaggcagagaacagcagcccggattcagggaagcagctggtgcactacacagcacagccactgttcctgctcgaccccggctccgtgggcaccgggagcagcgacttgccggtgctgtttgagctgggggagggctcctacttctccgaaggggacggcttcgcagaggaccccaccatctccctgctgacaggctcagagcctcccaaagccaaggaccccactgtctcctaggcgcccgggaggagctgggccagccgcccacccccacccccagtgcagggctggccttggggaggaagaggcagcctcgaggtcctgggcactggtgggttggccaccacagccccagtaggacaaacaggggctcaggtctgggcagcacctctggtcaggagggtcaccccggcctcccagtctgccttcccccaaccccgtgtcctgtggtttggttggggcttcgtagccacacctggactgaccctgcaggttgttcataatcagaattgtattttggatttttacacaactgtcccattccctgttccatagagatatacagatatatacacacaggtggatggacggacaagacaggcagagatctataaacagacag

SEQ ID NO: 2053 - RNA, 19 nt, Artificial
  siRNA construct
gcagguuguucauagucag

SEQ ID NO: 2054 - RNA, 19 nt, Artificial
  siRNA construct
cagguuguucauagucaga

SEQ ID NO: 2055 - RNA, 19 nt, Artificial
  siRNA construct
agguuguucauagucagaa

SEQ ID NO: 2056 - RNA, 19 nt, Artificial
  siRNA construct
gcccaaguacuucaagcac

SEQ ID NO: 2057 - RNA, 19 nt, Artificial
  siRNA construct
cccaaguacuucaagcaca

SEQ ID NO: 2058 - RNA, 19 nt, Artificial
  siRNA construct
ccaaguacuucaagcacaa

SEQ ID NO: 2059 - RNA, 19 nt, Artificial
  siRNA construct
caacaacauggccagcuuc

SEQ ID NO: 2060 - RNA, 19 nt, Artificial
  siRNA construct
guuccugaucucacuggug

SEQ ID NO: 2061 - RNA, 19 nt, Artificial
  siRNA construct
ucacuggugcagucaaacc

SEQ ID NO: 2062 - RNA, 19 nt, Artificial
  siRNA construct
uuggucaggaaggccggga

SEQ ID NO: 2063 - RNA, 19 nt, Artificial
  siRNA construct
cccggccuuccugaccaag

SEQ ID NO: 2064 - RNA, 19 nt, Artificial
  siRNA construct
cugacuaugaacaaccugc

SEQ ID NO: 2065 - RNA, 19 nt, Artificial
  siRNA construct
ucugacuaugaacaaccug

SEQ ID NO: 2066 - RNA, 19 nt, Artificial
  siRNA construct
uucugacuaugaacaaccu

SEQ ID NO: 2067 - RNA, 19 nt, Artificial
  siRNA construct
gugcuugaaguacuugggc

SEQ ID NO: 2068 - RNA, 19 nt, Artificial
  siRNA construct
ugugcuugaaguacuuggg

SEQ ID NO: 2069 - RNA, 19 nt, Artificial
  siRNA construct
uugugcuugaaguacuugg

SEQ ID NO: 2070 - RNA, 19 nt, Artificial
  siRNA construct
gaagcuggccauguuguug

SEQ ID NO: 2071 - RNA, 19 nt, Artificial
  siRNA construct
caccagugagaucaggaac

SEQ ID NO: 2072 - RNA, 19 nt, Artificial
  siRNA construct
gguuugacugcaccaguga

SEQ ID NO: 2073 - RNA, 19 nt, Artificial
  siRNA construct
ucccggccuuccugaccaa

SEQ ID NO: 2074 - RNA, 19 nt, Artificial
  siRNA construct
cuuggucaggaaggccggg

SEQ ID NO: 2075 - DNA, 21 bp, Artificial
  siRNA construct
gcagguuguucauagucagtt

SEQ ID NO: 2076 - DNA, 21 bp, Artificial
  siRNA construct
cagguuguucauagucagatt

SEQ ID NO: 2077 - DNA, 21 bp, Artificial
  siRNA construct
agguuguucauagucagaatt

SEQ ID NO: 2078 - DNA, 21 bp, Artificial
  siRNA construct
gcccaaguacuucaagcactt

SEQ ID NO: 2079 - DNA, 21 bp, Artificial
  siRNA construct
cccaaguacuucaagcacatt

SEQ ID NO: 2080 - DNA, 21 bp, Artificial
  siRNA construct
ccaaguacuucaagcacaatt

SEQ ID NO: 2081 - DNA, 21 bp, Artificial
  siRNA construct
caacaacauggccagcuuctt

SEQ ID NO: 2082 - DNA, 21 bp, Artificial
  siRNA construct
guuccugaucucacuggugtt

SEQ ID NO: 2083 - DNA, 21 bp, Artificial
  siRNA construct
ucacuggugcagucaaacctt

SEQ ID NO: 2084 - DNA, 21 bp, Artificial
  siRNA construct
uuggucaggaaggccgggatt

SEQ ID NO: 2085 - DNA, 21 bp, Artificial
  siRNA construct
cccggccuuccugaccaagtt

SEQ ID NO: 2086 - DNA, 21 bp, Artificial
  siRNA construct
cugacuaugaacaaccugctt

SEQ ID NO: 2087 - DNA, 21 bp, Artificial
  siRNA construct
ucugacuaugaacaaccugtt

SEQ ID NO: 2088 - DNA, 21 bp, Artificial
  siRNA construct
uucugacuaugaacaaccutt

SEQ ID NO: 2089 - DNA, 21 bp, Artificial
  siRNA construct
gugcuugaaguacuugggctt

SEQ ID NO: 2090 - DNA, 21 bp, Artificial
  siRNA construct
ugugcuugaaguacuugggtt

SEQ ID NO: 2091 - DNA, 21 bp, Artificial
  siRNA construct
uugugcuugaaguacuuggtt

SEQ ID NO: 2092 - DNA, 21 bp, Artificial
  siRNA construct
gaagcuggccauguuguugtt

SEQ ID NO: 2093 - DNA, 21 bp, Artificial
  siRNA construct
caccagugagaucaggaactt

SEQ ID NO: 2094 - DNA, 21 bp, Artificial
  siRNA construct
gguuugacugcaccagugatt

SEQ ID NO: 2095 - DNA, 21 bp, Artificial
  siRNA construct
ucccggccuuccugaccaatt

SEQ ID NO: 2096 - DNA, 21 bp, Artificial
  siRNA construct
cuuggucaggaaggccgggtt

SEQ ID NO: 2097 - RNA, 12 nt, Artificial
  siRNA construct
acgucccggccu

SEQ ID NO: 2098 - RNA, 12 nt, Artificial
  siRNA construct
cgucccggccuu

SEQ ID NO: 2099 - RNA, 12 nt, Artificial
  siRNA construct
gucccggccuuc

SEQ ID NO: 2100 - RNA, 12 nt, Artificial
  siRNA construct
ucccggccuucc

SEQ ID NO: 2101 - RNA, 12 nt, Artificial
  siRNA construct
cccggccuuccu

SEQ ID NO: 2102 - RNA, 12 nt, Artificial
  siRNA construct
ccggccuuccug

SEQ ID NO: 2103 - RNA, 12 nt, Artificial
  siRNA construct
cggccuuccuga

SEQ ID NO: 2104 - RNA, 12 nt, Artificial
  siRNA construct
ggccuuccugac

SEQ ID NO: 2105 - RNA, 12 nt, Artificial
  siRNA construct
gccuuccugacc

SEQ ID NO: 2106 - RNA, 12 nt, Artificial
  siRNA construct
ccuuccugacca

SEQ ID NO: 2107 - RNA, 12 nt, Artificial
  siRNA construct
cuuccugaccaa

SEQ ID NO: 2108 - RNA, 12 nt, Artificial
  siRNA construct
uuccugaccaag

SEQ ID NO: 2109 - RNA, 12 nt, Artificial
  siRNA construct
uccugaccaagc

SEQ ID NO: 2110 - RNA, 12 nt, Artificial
  siRNA construct
ccugaccaagcu

SEQ ID NO: 2111 - RNA, 12 nt, Artificial
  siRNA construct
cugaccaagcug

SEQ ID NO: 2112 - RNA, 12 nt, Artificial
  siRNA construct
ugaccaagcugu

SEQ ID NO: 2113 - RNA, 12 nt, Artificial
  siRNA construct
gaccaagcugug

SEQ ID NO: 2114 - RNA, 12 nt, Artificial
  siRNA construct
accaagcugugg

SEQ ID NO: 2115 - RNA, 12 nt, Artificial
  siRNA construct
ccaagcugugga

SEQ ID NO: 2116 - RNA, 12 nt, Artificial
  siRNA construct
caagcuguggac

SEQ ID NO: 2117 - RNA, 12 nt, Artificial
  siRNA construct
aagcuguggacc

SEQ ID NO: 2118 - RNA, 12 nt, Artificial
  siRNA construct
agcuguggaccc

SEQ ID NO: 2119 - RNA, 12 nt, Artificial
  siRNA construct
gcuguggacccu

SEQ ID NO: 2120 - RNA, 12 nt, Artificial
  siRNA construct
cuguggacccuc

SEQ ID NO: 2121 - RNA, 12 nt, Artificial
  siRNA construct
uguggacccucg

SEQ ID NO: 2122 - RNA, 12 nt, Artificial
  siRNA construct
guggacccucgu

SEQ ID NO: 2123 - RNA, 12 nt, Artificial
  siRNA construct
uggacccucgug

SEQ ID NO: 2124 - RNA, 12 nt, Artificial
  siRNA construct
ggacccucguga

SEQ ID NO: 2125 - RNA, 12 nt, Artificial
  siRNA construct
gacccucgugag

SEQ ID NO: 2126 - RNA, 12 nt, Artificial
  siRNA construct
acccucgugagc

SEQ ID NO: 2127 - RNA, 12 nt, Artificial
  siRNA construct
cccucgugagcg

SEQ ID NO: 2128 - RNA, 12 nt, Artificial
  siRNA construct
ccucgugagcga

SEQ ID NO: 2129 - RNA, 12 nt, Artificial
  siRNA construct
cucgugagcgac

SEQ ID NO: 2130 - RNA, 12 nt, Artificial
  siRNA construct
ucgugagcgacc

SEQ ID NO: 2131 - RNA, 12 nt, Artificial
  siRNA construct
cgugagcgaccc

SEQ ID NO: 2132 - RNA, 12 nt, Artificial
  siRNA construct
gugagcgacccg

SEQ ID NO: 2133 - RNA, 12 nt, Artificial
  siRNA construct
ugagcgacccgg

SEQ ID NO: 2134 - RNA, 12 nt, Artificial
  siRNA construct
gagcgacccgga

SEQ ID NO: 2135 - RNA, 12 nt, Artificial
  siRNA construct
agcgacccggac

SEQ ID NO: 2136 - RNA, 12 nt, Artificial
  siRNA construct
gcgacccggaca

SEQ ID NO: 2137 - RNA, 12 nt, Artificial
  siRNA construct
cgacccggacac

SEQ ID NO: 2138 - RNA, 12 nt, Artificial
  siRNA construct
gacccggacacc

SEQ ID NO: 2139 - RNA, 12 nt, Artificial
  siRNA construct
acccggacaccg

SEQ ID NO: 2140 - RNA, 12 nt, Artificial
  siRNA construct
ucaucugcugga

SEQ ID NO: 2141 - RNA, 12 nt, Artificial
  siRNA construct
caucugcuggag

SEQ ID NO: 2142 - RNA, 12 nt, Artificial
  siRNA construct
aucugcuggagc

SEQ ID NO: 2143 - RNA, 12 nt, Artificial
  siRNA construct
ucugcuggagcc

SEQ ID NO: 2144 - RNA, 12 nt, Artificial
  siRNA construct
cugcuggagccc

SEQ ID NO: 2145 - RNA, 12 nt, Artificial
  siRNA construct
ugcuggagcccg

SEQ ID NO: 2146 - RNA, 12 nt, Artificial
  siRNA construct
gcuggagcccga

SEQ ID NO: 2147 - RNA, 12 nt, Artificial
  siRNA construct
uguucgaccagg

SEQ ID NO: 2148 - RNA, 12 nt, Artificial
  siRNA construct
guucgaccaggg

SEQ ID NO: 2149 - RNA, 12 nt, Artificial
  siRNA construct
uucgaccagggc

SEQ ID NO: 2150 - RNA, 12 nt, Artificial
  siRNA construct
ucgaccagggcc

SEQ ID NO: 2151 - RNA, 12 nt, Artificial
  siRNA construct
cgaccagggcca

SEQ ID NO: 2152 - RNA, 12 nt, Artificial
  siRNA construct
gaccagggccag

SEQ ID NO: 2153 - RNA, 12 nt, Artificial
  siRNA construct
accagggccagu

SEQ ID NO: 2154 - RNA, 12 nt, Artificial
  siRNA construct
ccagggccaguu

SEQ ID NO: 2155 - RNA, 12 nt, Artificial
  siRNA construct
cagggccaguuu

SEQ ID NO: 2156 - RNA, 12 nt, Artificial
  siRNA construct
agggccaguuug

SEQ ID NO: 2157 - RNA, 12 nt, Artificial
  siRNA construct
gggccaguuugc

SEQ ID NO: 2158 - RNA, 12 nt, Artificial
  siRNA construct
ggccaguuugcc

SEQ ID NO: 2159 - RNA, 12 nt, Artificial
  siRNA construct
gccaguuugcca

SEQ ID NO: 2160 - RNA, 12 nt, Artificial
  siRNA construct
ccaguuugccaa

SEQ ID NO: 2161 - RNA, 12 nt, Artificial
  siRNA construct
caguuugccaag

SEQ ID NO: 2162 - RNA, 12 nt, Artificial
  siRNA construct
aguuugccaagg

SEQ ID NO: 2163 - RNA, 12 nt, Artificial
  siRNA construct
guuugccaagga

SEQ ID NO: 2164 - RNA, 12 nt, Artificial
  siRNA construct
uuugccaaggag

SEQ ID NO: 2165 - RNA, 12 nt, Artificial
  siRNA construct
uugccaaggagg

SEQ ID NO: 2166 - RNA, 12 nt, Artificial
  siRNA construct
ugccaaggaggu

SEQ ID NO: 2167 - RNA, 12 nt, Artificial
  siRNA construct
gccaaggaggug

SEQ ID NO: 2168 - RNA, 12 nt, Artificial
  siRNA construct
ccaaggaggugc

SEQ ID NO: 2169 - RNA, 12 nt, Artificial
  siRNA construct
caaggaggugcu

SEQ ID NO: 2170 - RNA, 12 nt, Artificial
  siRNA construct
aaggaggugcug

SEQ ID NO: 2171 - RNA, 12 nt, Artificial
  siRNA construct
aggaggugcugc

SEQ ID NO: 2172 - RNA, 12 nt, Artificial
  siRNA construct
ggaggugcugcc

SEQ ID NO: 2173 - RNA, 12 nt, Artificial
  siRNA construct
gaggugcugccc

SEQ ID NO: 2174 - RNA, 12 nt, Artificial
  siRNA construct
aggugcugccca

SEQ ID NO: 2175 - RNA, 12 nt, Artificial
  siRNA construct
ggugcugcccaa

SEQ ID NO: 2176 - RNA, 12 nt, Artificial
  siRNA construct
gugcugcccaag

SEQ ID NO: 2177 - RNA, 12 nt, Artificial
  siRNA construct
ugcugcccaagu

SEQ ID NO: 2178 - RNA, 12 nt, Artificial
  siRNA construct
cccaaguacuuc

SEQ ID NO: 2179 - RNA, 12 nt, Artificial
  siRNA construct
ccaaguacuuca

SEQ ID NO: 2180 - RNA, 12 nt, Artificial
  siRNA construct
caaguacuucaa

SEQ ID NO: 2181 - RNA, 12 nt, Artificial
  siRNA construct
aaguacuucaag

SEQ ID NO: 2182 - RNA, 12 nt, Artificial
  siRNA construct
aguacuucaagc

SEQ ID NO: 2183 - RNA, 12 nt, Artificial
  siRNA construct
guacuucaagca

SEQ ID NO: 2184 - RNA, 12 nt, Artificial
  siRNA construct
uacuucaagcac

SEQ ID NO: 2185 - RNA, 12 nt, Artificial
  siRNA construct
acuucaagcaca

SEQ ID NO: 2186 - RNA, 12 nt, Artificial
  siRNA construct
ucaagcacaaca

SEQ ID NO: 2187 - RNA, 12 nt, Artificial
  siRNA construct
caagcacaacaa

SEQ ID NO: 2188 - RNA, 12 nt, Artificial
  siRNA construct
aagcacaacaac

SEQ ID NO: 2189 - RNA, 12 nt, Artificial
  siRNA construct
agcacaacaaca

SEQ ID NO: 2190 - RNA, 12 nt, Artificial
  siRNA construct
gcacaacaacau

SEQ ID NO: 2191 - RNA, 12 nt, Artificial
  siRNA construct
cacaacaacaug

SEQ ID NO: 2192 - RNA, 12 nt, Artificial
  siRNA construct
acaacaacaugg

SEQ ID NO: 2193 - RNA, 12 nt, Artificial
  siRNA construct
caacaacauggc

SEQ ID NO: 2194 - RNA, 12 nt, Artificial
  siRNA construct
aacaacauggcc

SEQ ID NO: 2195 - RNA, 12 nt, Artificial
  siRNA construct
acaacauggcca

SEQ ID NO: 2196 - RNA, 12 nt, Artificial
  siRNA construct
caacauggccag

SEQ ID NO: 2197 - RNA, 12 nt, Artificial
  siRNA construct
aacauggccagc

SEQ ID NO: 2198 - RNA, 12 nt, Artificial
  siRNA construct
acauggccagcu

SEQ ID NO: 2199 - RNA, 12 nt, Artificial
  siRNA construct
cauggccagcuu

SEQ ID NO: 2200 - RNA, 12 nt, Artificial
  siRNA construct
auggccagcuuc

SEQ ID NO: 2201 - RNA, 12 nt, Artificial
  siRNA construct
uggccagcuucg

SEQ ID NO: 2202 - RNA, 12 nt, Artificial
  siRNA construct
ggccagcuucgu

SEQ ID NO: 2203 - RNA, 12 nt, Artificial
  siRNA construct
gccagcuucgug

SEQ ID NO: 2204 - RNA, 12 nt, Artificial
  siRNA construct
ccagcuucgugc

SEQ ID NO: 2205 - RNA, 12 nt, Artificial
  siRNA construct
cagcuucgugcg

SEQ ID NO: 2206 - RNA, 12 nt, Artificial
  siRNA construct
agcuucgugcgg

SEQ ID NO: 2207 - RNA, 12 nt, Artificial
  siRNA construct
gcuucgugcggc

SEQ ID NO: 2208 - RNA, 12 nt, Artificial
  siRNA construct
gccaggagcagc

SEQ ID NO: 2209 - RNA, 12 nt, Artificial
  siRNA construct
ccaggagcagcu

SEQ ID NO: 2210 - RNA, 12 nt, Artificial
  siRNA construct
caggagcagcuc

SEQ ID NO: 2211 - RNA, 12 nt, Artificial
  siRNA construct
aggagcagcucc

SEQ ID NO: 2212 - RNA, 12 nt, Artificial
  siRNA construct
ggagcagcuccu

SEQ ID NO: 2213 - RNA, 12 nt, Artificial
  siRNA construct
gagcagcuccuu

SEQ ID NO: 2214 - RNA, 12 nt, Artificial
  siRNA construct
agcagcuccuug

SEQ ID NO: 2215 - RNA, 12 nt, Artificial
  siRNA construct
gcagcuccuuga

SEQ ID NO: 2216 - RNA, 12 nt, Artificial
  siRNA construct
cagcuccuugag

SEQ ID NO: 2217 - RNA, 12 nt, Artificial
  siRNA construct
agcuccuugaga

SEQ ID NO: 2218 - RNA, 12 nt, Artificial
  siRNA construct
gcuccuugagaa

SEQ ID NO: 2219 - RNA, 12 nt, Artificial
  siRNA construct
cuccuugagaac

SEQ ID NO: 2220 - RNA, 12 nt, Artificial
  siRNA construct
uccuugagaaca

SEQ ID NO: 2221 - RNA, 12 nt, Artificial
  siRNA construct
ccuugagaacau

SEQ ID NO: 2222 - RNA, 12 nt, Artificial
  siRNA construct
cuugagaacauc

SEQ ID NO: 2223 - RNA, 12 nt, Artificial
  siRNA construct
uugagaacauca

SEQ ID NO: 2224 - RNA, 12 nt, Artificial
  siRNA construct
ugagaacaucaa

SEQ ID NO: 2225 - RNA, 12 nt, Artificial
  siRNA construct
gagaacaucaag

SEQ ID NO: 2226 - RNA, 12 nt, Artificial
  siRNA construct
agaacaucaaga

SEQ ID NO: 2227 - RNA, 12 nt, Artificial
  siRNA construct
gaacaucaagag

SEQ ID NO: 2228 - RNA, 12 nt, Artificial
  siRNA construct
aacaucaagagg

SEQ ID NO: 2229 - RNA, 12 nt, Artificial
  siRNA construct
acaucaagagga

SEQ ID NO: 2230 - RNA, 12 nt, Artificial
  siRNA construct
caucaagaggaa

SEQ ID NO: 2231 - RNA, 12 nt, Artificial
  siRNA construct
aucaagaggaaa

SEQ ID NO: 2232 - RNA, 12 nt, Artificial
  siRNA construct
ucaagaggaaag

SEQ ID NO: 2233 - RNA, 12 nt, Artificial
  siRNA construct
caagaggaaagu

SEQ ID NO: 2234 - RNA, 12 nt, Artificial
  siRNA construct
aagaggaaagug

SEQ ID NO: 2235 - RNA, 12 nt, Artificial
  siRNA construct
agaggaaaguga

SEQ ID NO: 2236 - RNA, 12 nt, Artificial
  siRNA construct
gaggaaagugac

SEQ ID NO: 2237 - RNA, 12 nt, Artificial
  siRNA construct
aggaaagugacc

SEQ ID NO: 2238 - RNA, 12 nt, Artificial
  siRNA construct
ggaaagugacca

SEQ ID NO: 2239 - RNA, 12 nt, Artificial
  siRNA construct
gaaagugaccag

SEQ ID NO: 2240 - RNA, 12 nt, Artificial
  siRNA construct
aaagugaccagu

SEQ ID NO: 2241 - RNA, 12 nt, Artificial
  siRNA construct
aagugaccagug

SEQ ID NO: 2242 - RNA, 12 nt, Artificial
  siRNA construct
agugaccagugu

SEQ ID NO: 2243 - RNA, 12 nt, Artificial
  siRNA construct
gugaccagugug

SEQ ID NO: 2244 - RNA, 12 nt, Artificial
  siRNA construct
ugaccagugugu

SEQ ID NO: 2245 - RNA, 12 nt, Artificial
  siRNA construct
gaccaguguguc

SEQ ID NO: 2246 - RNA, 12 nt, Artificial
  siRNA construct
accagugugucc

SEQ ID NO: 2247 - RNA, 12 nt, Artificial
  siRNA construct
ccagugugucca

SEQ ID NO: 2248 - RNA, 12 nt, Artificial
  siRNA construct
caguguguccac

SEQ ID NO: 2249 - RNA, 12 nt, Artificial
  siRNA construct
aguguguccacc

SEQ ID NO: 2250 - RNA, 12 nt, Artificial
  siRNA construct
guguguccaccc

SEQ ID NO: 2251 - RNA, 12 nt, Artificial
  siRNA construct
uguguccacccu

SEQ ID NO: 2252 - RNA, 12 nt, Artificial
  siRNA construct
guguccacccug

SEQ ID NO: 2253 - RNA, 12 nt, Artificial
  siRNA construct
uguccacccuga

SEQ ID NO: 2254 - RNA, 12 nt, Artificial
  siRNA construct
guccacccugaa

SEQ ID NO: 2255 - RNA, 12 nt, Artificial
  siRNA construct
uccacccugaag

SEQ ID NO: 2256 - RNA, 12 nt, Artificial
  siRNA construct
ccacccugaaga

SEQ ID NO: 2257 - RNA, 12 nt, Artificial
  siRNA construct
cacccugaagag

SEQ ID NO: 2258 - RNA, 12 nt, Artificial
  siRNA construct
acccugaagagu

SEQ ID NO: 2259 - RNA, 12 nt, Artificial
  siRNA construct
cccugaagagug

SEQ ID NO: 2260 - RNA, 12 nt, Artificial
  siRNA construct
ccugaagaguga

SEQ ID NO: 2261 - RNA, 12 nt, Artificial
  siRNA construct
cugaagagugaa

SEQ ID NO: 2262 - RNA, 12 nt, Artificial
  siRNA construct
ugaagagugaag

SEQ ID NO: 2263 - RNA, 12 nt, Artificial
  siRNA construct
gaagagugaaga

SEQ ID NO: 2264 - RNA, 12 nt, Artificial
  siRNA construct
aagagugaagac

SEQ ID NO: 2265 - RNA, 12 nt, Artificial
  siRNA construct
agagugaagaca

SEQ ID NO: 2266 - RNA, 12 nt, Artificial
  siRNA construct
gagugaagacau

SEQ ID NO: 2267 - RNA, 12 nt, Artificial
  siRNA construct
agugaagacaua

SEQ ID NO: 2268 - RNA, 12 nt, Artificial
  siRNA construct
gugaagacauaa

SEQ ID NO: 2269 - RNA, 12 nt, Artificial
  siRNA construct
ugaagacauaaa

SEQ ID NO: 2270 - RNA, 12 nt, Artificial
  siRNA construct
gaagacauaaag

SEQ ID NO: 2271 - RNA, 12 nt, Artificial
  siRNA construct
aagacauaaaga

SEQ ID NO: 2272 - RNA, 12 nt, Artificial
  siRNA construct
agacauaaagau

SEQ ID NO: 2273 - RNA, 12 nt, Artificial
  siRNA construct
gacauaaagauc

SEQ ID NO: 2274 - RNA, 12 nt, Artificial
  siRNA construct
acauaaagaucc

SEQ ID NO: 2275 - RNA, 12 nt, Artificial
  siRNA construct
ucaccaagcugc

SEQ ID NO: 2276 - RNA, 12 nt, Artificial
  siRNA construct
caccaagcugcu

SEQ ID NO: 2277 - RNA, 12 nt, Artificial
  siRNA construct
accaagcugcug

SEQ ID NO: 2278 - RNA, 12 nt, Artificial
  siRNA construct
ccaagcugcuga

SEQ ID NO: 2279 - RNA, 12 nt, Artificial
  siRNA construct
caagcugcugac

SEQ ID NO: 2280 - RNA, 12 nt, Artificial
  siRNA construct
aagcugcugacg

SEQ ID NO: 2281 - RNA, 12 nt, Artificial
  siRNA construct
agcugcugacgg

SEQ ID NO: 2282 - RNA, 12 nt, Artificial
  siRNA construct
gcugcugacgga

SEQ ID NO: 2283 - RNA, 12 nt, Artificial
  siRNA construct
cugcugacggac

SEQ ID NO: 2284 - RNA, 12 nt, Artificial
  siRNA construct
ugcugacggacg

SEQ ID NO: 2285 - RNA, 12 nt, Artificial
  siRNA construct
gcugacggacgu

SEQ ID NO: 2286 - RNA, 12 nt, Artificial
  siRNA construct
cugacggacgug

SEQ ID NO: 2287 - RNA, 12 nt, Artificial
  siRNA construct
ugacggacgugc

SEQ ID NO: 2288 - RNA, 12 nt, Artificial
  siRNA construct
gacggacgugca

SEQ ID NO: 2289 - RNA, 12 nt, Artificial
  siRNA construct
acggacgugcag

SEQ ID NO: 2290 - RNA, 12 nt, Artificial
  siRNA construct
cggacgugcagc

SEQ ID NO: 2291 - RNA, 12 nt, Artificial
  siRNA construct
ggacgugcagcu

SEQ ID NO: 2292 - RNA, 12 nt, Artificial
  siRNA construct
gacgugcagcug

SEQ ID NO: 2293 - RNA, 12 nt, Artificial
  siRNA construct
acgugcagcuga

SEQ ID NO: 2294 - RNA, 12 nt, Artificial
  siRNA construct
cgugcagcugau

SEQ ID NO: 2295 - RNA, 12 nt, Artificial
  siRNA construct
gugcagcugaug

SEQ ID NO: 2296 - RNA, 12 nt, Artificial
  siRNA construct
ugcagcugauga

SEQ ID NO: 2297 - RNA, 12 nt, Artificial
  siRNA construct
gcagcugaugaa

SEQ ID NO: 2298 - RNA, 12 nt, Artificial
  siRNA construct
cagcugaugaag

SEQ ID NO: 2299 - RNA, 12 nt, Artificial
  siRNA construct
agcugaugaagg

SEQ ID NO: 2300 - RNA, 12 nt, Artificial
  siRNA construct
agaaugaggcuc

SEQ ID NO: 2301 - RNA, 12 nt, Artificial
  siRNA construct
gaaugaggcucu

SEQ ID NO: 2302 - RNA, 12 nt, Artificial
  siRNA construct
aaugaggcucug

SEQ ID NO: 2303 - RNA, 12 nt, Artificial
  siRNA construct
augaggcucugu

SEQ ID NO: 2304 - RNA, 12 nt, Artificial
  siRNA construct
ugaggcucugug

SEQ ID NO: 2305 - RNA, 12 nt, Artificial
  siRNA construct
gaggcucugugg

SEQ ID NO: 2306 - RNA, 12 nt, Artificial
  siRNA construct
aggcucuguggc

SEQ ID NO: 2307 - RNA, 12 nt, Artificial
  siRNA construct
ggcucuguggcg

SEQ ID NO: 2308 - RNA, 12 nt, Artificial
  siRNA construct
gcucuguggcgg

SEQ ID NO: 2309 - RNA, 12 nt, Artificial
  siRNA construct
cucuguggcggg

SEQ ID NO: 2310 - RNA, 12 nt, Artificial
  siRNA construct
ucuguggcggga

SEQ ID NO: 2311 - RNA, 12 nt, Artificial
  siRNA construct
cuguggcgggag

SEQ ID NO: 2312 - RNA, 12 nt, Artificial
  siRNA construct
uguggcgggagg

SEQ ID NO: 2313 - RNA, 12 nt, Artificial
  siRNA construct
guggcgggaggu

SEQ ID NO: 2314 - RNA, 12 nt, Artificial
  siRNA construct
uggcgggaggug

SEQ ID NO: 2315 - RNA, 12 nt, Artificial
  siRNA construct
ggcgggaggugg

SEQ ID NO: 2316 - RNA, 12 nt, Artificial
  siRNA construct
gcgggagguggc

SEQ ID NO: 2317 - RNA, 12 nt, Artificial
  siRNA construct
cgggagguggcc

SEQ ID NO: 2318 - RNA, 12 nt, Artificial
  siRNA construct
gggagguggcca

SEQ ID NO: 2319 - RNA, 12 nt, Artificial
  siRNA construct
ggagguggccag

SEQ ID NO: 2320 - RNA, 12 nt, Artificial
  siRNA construct
gagguggccagc

SEQ ID NO: 2321 - RNA, 12 nt, Artificial
  siRNA construct
agguggccagcc

SEQ ID NO: 2322 - RNA, 12 nt, Artificial
  siRNA construct
gguggccagccu

SEQ ID NO: 2323 - RNA, 12 nt, Artificial
  siRNA construct
guggccagccuu

SEQ ID NO: 2324 - RNA, 12 nt, Artificial
  siRNA construct
uggccagccuuc

SEQ ID NO: 2325 - RNA, 12 nt, Artificial
  siRNA construct
ggccagccuucg

SEQ ID NO: 2326 - RNA, 12 nt, Artificial
  siRNA construct
gccagccuucgg

SEQ ID NO: 2327 - RNA, 12 nt, Artificial
  siRNA construct
ccagccuucggc

SEQ ID NO: 2328 - RNA, 12 nt, Artificial
  siRNA construct
cagccuucggca

SEQ ID NO: 2329 - RNA, 12 nt, Artificial
  siRNA construct
agccuucggcag

SEQ ID NO: 2330 - RNA, 12 nt, Artificial
  siRNA construct
gccuucggcaga

SEQ ID NO: 2331 - RNA, 12 nt, Artificial
  siRNA construct
ccuucggcagaa

SEQ ID NO: 2332 - RNA, 12 nt, Artificial
  siRNA construct
cuucggcagaag

SEQ ID NO: 2333 - RNA, 12 nt, Artificial
  siRNA construct
uucggcagaagc

SEQ ID NO: 2334 - RNA, 12 nt, Artificial
  siRNA construct
ucggcagaagca

SEQ ID NO: 2335 - RNA, 12 nt, Artificial
  siRNA construct
cggcagaagcau

SEQ ID NO: 2336 - RNA, 12 nt, Artificial
  siRNA construct
ggcagaagcaug

SEQ ID NO: 2337 - RNA, 12 nt, Artificial
  siRNA construct
gcagaagcaugc

SEQ ID NO: 2338 - RNA, 12 nt, Artificial
  siRNA construct
cagaagcaugcc

SEQ ID NO: 2339 - RNA, 12 nt, Artificial
  siRNA construct
agaagcaugccc

SEQ ID NO: 2340 - RNA, 12 nt, Artificial
  siRNA construct
gaagcaugccca

SEQ ID NO: 2341 - RNA, 12 nt, Artificial
  siRNA construct
aagcaugcccag

SEQ ID NO: 2342 - RNA, 12 nt, Artificial
  siRNA construct
agcaugcccagc

SEQ ID NO: 2343 - RNA, 12 nt, Artificial
  siRNA construct
gcaugcccagca

SEQ ID NO: 2344 - RNA, 12 nt, Artificial
  siRNA construct
caugcccagcaa

SEQ ID NO: 2345 - RNA, 12 nt, Artificial
  siRNA construct
augcccagcaac

SEQ ID NO: 2346 - RNA, 12 nt, Artificial
  siRNA construct
ugcccagcaaca

SEQ ID NO: 2347 - RNA, 12 nt, Artificial
  siRNA construct
gcccagcaacag

SEQ ID NO: 2348 - RNA, 12 nt, Artificial
  siRNA construct
cccagcaacaga

SEQ ID NO: 2349 - RNA, 12 nt, Artificial
  siRNA construct
ccagcaacagaa

SEQ ID NO: 2350 - RNA, 12 nt, Artificial
  siRNA construct
cagcaacagaaa

SEQ ID NO: 2351 - RNA, 12 nt, Artificial
  siRNA construct
agcaacagaaag

SEQ ID NO: 2352 - RNA, 12 nt, Artificial
  siRNA construct
gcaacagaaagu

SEQ ID NO: 2353 - RNA, 12 nt, Artificial
  siRNA construct
aagcucauucag

SEQ ID NO: 2354 - RNA, 12 nt, Artificial
  siRNA construct
agcucauucagu

SEQ ID NO: 2355 - RNA, 12 nt, Artificial
  siRNA construct
gcucauucaguu

SEQ ID NO: 2356 - RNA, 12 nt, Artificial
  siRNA construct
cucauucaguuc

SEQ ID NO: 2357 - RNA, 12 nt, Artificial
  siRNA construct
ucauucaguucc

SEQ ID NO: 2358 - RNA, 12 nt, Artificial
  siRNA construct
cauucaguuccu

SEQ ID NO: 2359 - RNA, 12 nt, Artificial
  siRNA construct
auucaguuccug

SEQ ID NO: 2360 - RNA, 12 nt, Artificial
  siRNA construct
uucaguuccuga

SEQ ID NO: 2361 - RNA, 12 nt, Artificial
  siRNA construct
ucaguuccugau

SEQ ID NO: 2362 - RNA, 12 nt, Artificial
  siRNA construct
caguuccugauc

SEQ ID NO: 2363 - RNA, 12 nt, Artificial
  siRNA construct
aguuccugaucu

SEQ ID NO: 2364 - RNA, 12 nt, Artificial
  siRNA construct
guuccugaucuc

SEQ ID NO: 2365 - RNA, 12 nt, Artificial
  siRNA construct
uuccugaucuca

SEQ ID NO: 2366 - RNA, 12 nt, Artificial
  siRNA construct
uccugaucucac

SEQ ID NO: 2367 - RNA, 12 nt, Artificial
  siRNA construct
ccugaucucacu

SEQ ID NO: 2368 - RNA, 12 nt, Artificial
  siRNA construct
cugaucucacug

SEQ ID NO: 2369 - RNA, 12 nt, Artificial
  siRNA construct
ugaucucacugg

SEQ ID NO: 2370 - RNA, 12 nt, Artificial
  siRNA construct
gaucucacuggu

SEQ ID NO: 2371 - RNA, 12 nt, Artificial
  siRNA construct
aucucacuggug

SEQ ID NO: 2372 - RNA, 12 nt, Artificial
  siRNA construct
ucucacuggugc

SEQ ID NO: 2373 - RNA, 12 nt, Artificial
  siRNA construct
cucacuggugca

SEQ ID NO: 2374 - RNA, 12 nt, Artificial
  siRNA construct
ucacuggugcag

SEQ ID NO: 2375 - RNA, 12 nt, Artificial
  siRNA construct
cacuggugcagu

SEQ ID NO: 2376 - RNA, 12 nt, Artificial
  siRNA construct
acuggugcaguc

SEQ ID NO: 2377 - RNA, 12 nt, Artificial
  siRNA construct
cuggugcaguca

SEQ ID NO: 2378 - RNA, 12 nt, Artificial
  siRNA construct
uggugcagucaa

SEQ ID NO: 2379 - RNA, 12 nt, Artificial
  siRNA construct
ggugcagucaaa

SEQ ID NO: 2380 - RNA, 12 nt, Artificial
  siRNA construct
gugcagucaaac

SEQ ID NO: 2381 - RNA, 12 nt, Artificial
  siRNA construct
ugcagucaaacc

SEQ ID NO: 2382 - RNA, 12 nt, Artificial
  siRNA construct
gcagucaaaccg

SEQ ID NO: 2383 - RNA, 12 nt, Artificial
  siRNA construct
cagucaaaccgg

SEQ ID NO: 2384 - RNA, 12 nt, Artificial
  siRNA construct
agucaaaccgga

SEQ ID NO: 2385 - RNA, 12 nt, Artificial
  siRNA construct
gucaaaccggau

SEQ ID NO: 2386 - RNA, 12 nt, Artificial
  siRNA construct
ucaaaccggauc

SEQ ID NO: 2387 - RNA, 12 nt, Artificial
  siRNA construct
caaaccggaucc

SEQ ID NO: 2388 - RNA, 12 nt, Artificial
  siRNA construct
aaaccggauccu

SEQ ID NO: 2389 - RNA, 12 nt, Artificial
  siRNA construct
aaccggauccug

SEQ ID NO: 2390 - RNA, 12 nt, Artificial
  siRNA construct
accggauccugg

SEQ ID NO: 2391 - RNA, 12 nt, Artificial
  siRNA construct
ccugaugcugaa

SEQ ID NO: 2392 - RNA, 12 nt, Artificial
  siRNA construct
cugaugcugaac

SEQ ID NO: 2393 - RNA, 12 nt, Artificial
  siRNA construct
ugaugcugaacg

SEQ ID NO: 2394 - RNA, 12 nt, Artificial
  siRNA construct
gaugcugaacga

SEQ ID NO: 2395 - RNA, 12 nt, Artificial
  siRNA construct
augcugaacgac

SEQ ID NO: 2396 - RNA, 12 nt, Artificial
  siRNA construct
ugcugaacgaca

SEQ ID NO: 2397 - RNA, 12 nt, Artificial
  siRNA construct
gcugaacgacag

SEQ ID NO: 2398 - RNA, 12 nt, Artificial
  siRNA construct
cugaacgacagu

SEQ ID NO: 2399 - RNA, 12 nt, Artificial
  siRNA construct
ugaacgacagug

SEQ ID NO: 2400 - RNA, 12 nt, Artificial
  siRNA construct
gaacgacagugg

SEQ ID NO: 2401 - RNA, 12 nt, Artificial
  siRNA construct
aacgacaguggc

SEQ ID NO: 2402 - RNA, 12 nt, Artificial
  siRNA construct
acgacaguggcu

SEQ ID NO: 2403 - RNA, 12 nt, Artificial
  siRNA construct
cgacaguggcuc

SEQ ID NO: 2404 - RNA, 12 nt, Artificial
  siRNA construct
gacaguggcuca

SEQ ID NO: 2405 - RNA, 12 nt, Artificial
  siRNA construct
acaguggcucag

SEQ ID NO: 2406 - RNA, 12 nt, Artificial
  siRNA construct
caguggcucagc

SEQ ID NO: 2407 - RNA, 12 nt, Artificial
  siRNA construct
aguggcucagca

SEQ ID NO: 2408 - RNA, 12 nt, Artificial
  siRNA construct
guggcucagcac

SEQ ID NO: 2409 - RNA, 12 nt, Artificial
  siRNA construct
uggcucagcaca

SEQ ID NO: 2410 - RNA, 12 nt, Artificial
  siRNA construct
ggcucagcacau

SEQ ID NO: 2411 - RNA, 12 nt, Artificial
  siRNA construct
gcucagcacauu

SEQ ID NO: 2412 - RNA, 12 nt, Artificial
  siRNA construct
cucagcacauuc

SEQ ID NO: 2413 - RNA, 12 nt, Artificial
  siRNA construct
ucagcacauucc

SEQ ID NO: 2414 - RNA, 12 nt, Artificial
  siRNA construct
cagcacauucca

SEQ ID NO: 2415 - RNA, 12 nt, Artificial
  siRNA construct
agcacauuccau

SEQ ID NO: 2416 - RNA, 12 nt, Artificial
  siRNA construct
gcacauuccaug

SEQ ID NO: 2417 - RNA, 12 nt, Artificial
  siRNA construct
cacauuccaugc

SEQ ID NO: 2418 - RNA, 12 nt, Artificial
  siRNA construct
acauuccaugcc

SEQ ID NO: 2419 - RNA, 12 nt, Artificial
  siRNA construct
cauuccaugccc

SEQ ID NO: 2420 - RNA, 12 nt, Artificial
  siRNA construct
auuccaugccca

SEQ ID NO: 2421 - RNA, 12 nt, Artificial
  siRNA construct
uuccaugcccaa

SEQ ID NO: 2422 - RNA, 12 nt, Artificial
  siRNA construct
uccaugcccaag

SEQ ID NO: 2423 - RNA, 12 nt, Artificial
  siRNA construct
ccaugcccaagu

SEQ ID NO: 2424 - RNA, 12 nt, Artificial
  siRNA construct
caugcccaagua

SEQ ID NO: 2425 - RNA, 12 nt, Artificial
  siRNA construct
ccggcaguucuc

SEQ ID NO: 2426 - RNA, 12 nt, Artificial
  siRNA construct
cggcaguucucc

SEQ ID NO: 2427 - RNA, 12 nt, Artificial
  siRNA construct
ggcaguucuccc

SEQ ID NO: 2428 - RNA, 12 nt, Artificial
  siRNA construct
gcaguucucccu

SEQ ID NO: 2429 - RNA, 12 nt, Artificial
  siRNA construct
caguucucccug

SEQ ID NO: 2430 - RNA, 12 nt, Artificial
  siRNA construct
aguucucccugg

SEQ ID NO: 2431 - RNA, 12 nt, Artificial
  siRNA construct
guucucccugga

SEQ ID NO: 2432 - RNA, 12 nt, Artificial
  siRNA construct
uucucccuggag

SEQ ID NO: 2433 - RNA, 12 nt, Artificial
  siRNA construct
ucucccuggagc

SEQ ID NO: 2434 - RNA, 12 nt, Artificial
  siRNA construct
cucccuggagca

SEQ ID NO: 2435 - RNA, 12 nt, Artificial
  siRNA construct
ucccuggagcac

SEQ ID NO: 2436 - RNA, 12 nt, Artificial
  siRNA construct
cccuggagcacg

SEQ ID NO: 2437 - RNA, 12 nt, Artificial
  siRNA construct
ccuggagcacgu

SEQ ID NO: 2438 - RNA, 12 nt, Artificial
  siRNA construct
cuggagcacguc

SEQ ID NO: 2439 - RNA, 12 nt, Artificial
  siRNA construct
uggagcacgucc

SEQ ID NO: 2440 - RNA, 12 nt, Artificial
  siRNA construct
ggagcacgucca

SEQ ID NO: 2441 - RNA, 12 nt, Artificial
  siRNA construct
gagcacguccac

SEQ ID NO: 2442 - RNA, 12 nt, Artificial
  siRNA construct
agcacguccacg

SEQ ID NO: 2443 - RNA, 12 nt, Artificial
  siRNA construct
gcacguccacgg

SEQ ID NO: 2444 - RNA, 12 nt, Artificial
  siRNA construct
cacguccacggc

SEQ ID NO: 2445 - RNA, 12 nt, Artificial
  siRNA construct
acguccacggcu

SEQ ID NO: 2446 - RNA, 12 nt, Artificial
  siRNA construct
uccgacaucacc

SEQ ID NO: 2447 - RNA, 12 nt, Artificial
  siRNA construct
ccgacaucaccg

SEQ ID NO: 2448 - RNA, 12 nt, Artificial
  siRNA construct
cgacaucaccga

SEQ ID NO: 2449 - RNA, 12 nt, Artificial
  siRNA construct
gacaucaccgag

SEQ ID NO: 2450 - RNA, 12 nt, Artificial
  siRNA construct
acaucaccgagc

SEQ ID NO: 2451 - RNA, 12 nt, Artificial
  siRNA construct
caucaccgagcu

SEQ ID NO: 2452 - RNA, 12 nt, Artificial
  siRNA construct
aucaccgagcug

SEQ ID NO: 2453 - RNA, 12 nt, Artificial
  siRNA construct
ucaccgagcugg

SEQ ID NO: 2454 - RNA, 12 nt, Artificial
  siRNA construct
caccgagcuggc

SEQ ID NO: 2455 - RNA, 12 nt, Artificial
  siRNA construct
accgagcuggcu

SEQ ID NO: 2456 - RNA, 12 nt, Artificial
  siRNA construct
ccgagcuggcuc

SEQ ID NO: 2457 - RNA, 12 nt, Artificial
  siRNA construct
cgagcuggcucc

SEQ ID NO: 2458 - RNA, 12 nt, Artificial
  siRNA construct
gagcuggcuccu

SEQ ID NO: 2459 - RNA, 12 nt, Artificial
  siRNA construct
agcuggcuccug

SEQ ID NO: 2460 - RNA, 12 nt, Artificial
  siRNA construct
gcuggcuccugc

SEQ ID NO: 2461 - RNA, 12 nt, Artificial
  siRNA construct
cuggcuccugcc

SEQ ID NO: 2462 - RNA, 12 nt, Artificial
  siRNA construct
uggcuccugcca

SEQ ID NO: 2463 - RNA, 12 nt, Artificial
  siRNA construct
ggcuccugccag

SEQ ID NO: 2464 - RNA, 12 nt, Artificial
  siRNA construct
gcuccugccagc

SEQ ID NO: 2465 - RNA, 12 nt, Artificial
  siRNA construct
cuccugccagcc

SEQ ID NO: 2466 - RNA, 12 nt, Artificial
  siRNA construct
gcgggagcauag

SEQ ID NO: 2467 - RNA, 12 nt, Artificial
  siRNA construct
cgggagcauaga

SEQ ID NO: 2468 - RNA, 12 nt, Artificial
  siRNA construct
gggagcauagac

SEQ ID NO: 2469 - RNA, 12 nt, Artificial
  siRNA construct
ggagcauagacg

SEQ ID NO: 2470 - RNA, 12 nt, Artificial
  siRNA construct
gagcauagacga

SEQ ID NO: 2471 - RNA, 12 nt, Artificial
  siRNA construct
agcauagacgag

SEQ ID NO: 2472 - RNA, 12 nt, Artificial
  siRNA construct
gcauagacgaga

SEQ ID NO: 2473 - RNA, 12 nt, Artificial
  siRNA construct
cauagacgagag

SEQ ID NO: 2474 - RNA, 12 nt, Artificial
  siRNA construct
auagacgagagg

SEQ ID NO: 2475 - RNA, 12 nt, Artificial
  siRNA construct
uagacgagaggc

SEQ ID NO: 2476 - RNA, 12 nt, Artificial
  siRNA construct
agacgagaggcc

SEQ ID NO: 2477 - RNA, 12 nt, Artificial
  siRNA construct
ccuggugcgugu

SEQ ID NO: 2478 - RNA, 12 nt, Artificial
  siRNA construct
cuggugcguguc

SEQ ID NO: 2479 - RNA, 12 nt, Artificial
  siRNA construct
uggugcguguca

SEQ ID NO: 2480 - RNA, 12 nt, Artificial
  siRNA construct
ggugcgugucaa

SEQ ID NO: 2481 - RNA, 12 nt, Artificial
  siRNA construct
gugcgugucaag

SEQ ID NO: 2482 - RNA, 12 nt, Artificial
  siRNA construct
ugcgugucaagg

SEQ ID NO: 2483 - RNA, 12 nt, Artificial
  siRNA construct
gcgugucaagga

SEQ ID NO: 2484 - RNA, 12 nt, Artificial
  siRNA construct
cgugucaaggag

SEQ ID NO: 2485 - RNA, 12 nt, Artificial
  siRNA construct
gugucaaggagg

SEQ ID NO: 2486 - RNA, 12 nt, Artificial
  siRNA construct
ugucaaggagga

SEQ ID NO: 2487 - RNA, 12 nt, Artificial
  siRNA construct
gucaaggaggag

SEQ ID NO: 2488 - RNA, 12 nt, Artificial
  siRNA construct
ucaaggaggagc

SEQ ID NO: 2489 - RNA, 12 nt, Artificial
  siRNA construct
caaggaggagcc

SEQ ID NO: 2490 - RNA, 12 nt, Artificial
  siRNA construct
acuuggaugcua

SEQ ID NO: 2491 - RNA, 12 nt, Artificial
  siRNA construct
cuuggaugcuau

SEQ ID NO: 2492 - RNA, 12 nt, Artificial
  siRNA construct
uuggaugcuaug

SEQ ID NO: 2493 - RNA, 12 nt, Artificial
  siRNA construct
uggaugcuaugg

SEQ ID NO: 2494 - RNA, 12 nt, Artificial
  siRNA construct
ggaugcuaugga

SEQ ID NO: 2495 - RNA, 12 nt, Artificial
  siRNA construct
gaugcuauggac

SEQ ID NO: 2496 - RNA, 12 nt, Artificial
  siRNA construct
augcuauggacu

SEQ ID NO: 2497 - RNA, 12 nt, Artificial
  siRNA construct
ugcuauggacuc

SEQ ID NO: 2498 - RNA, 12 nt, Artificial
  siRNA construct
gcuauggacucc

SEQ ID NO: 2499 - RNA, 12 nt, Artificial
  siRNA construct
cuauggacucca

SEQ ID NO: 2500 - RNA, 12 nt, Artificial
  siRNA construct
uauggacuccaa

SEQ ID NO: 2501 - RNA, 12 nt, Artificial
  siRNA construct
auggacuccaac

SEQ ID NO: 2502 - RNA, 12 nt, Artificial
  siRNA construct
uggacuccaacc

SEQ ID NO: 2503 - RNA, 12 nt, Artificial
  siRNA construct
ggacuccaaccu

SEQ ID NO: 2504 - RNA, 12 nt, Artificial
  siRNA construct
gacuccaaccug

SEQ ID NO: 2505 - RNA, 12 nt, Artificial
  siRNA construct
acuccaaccugg

SEQ ID NO: 2506 - RNA, 12 nt, Artificial
  siRNA construct
accugcagacca

SEQ ID NO: 2507 - RNA, 12 nt, Artificial
  siRNA construct
ccugcagaccau

SEQ ID NO: 2508 - RNA, 12 nt, Artificial
  siRNA construct
cugcagaccaug

SEQ ID NO: 2509 - RNA, 12 nt, Artificial
  siRNA construct
ugcagaccaugc

SEQ ID NO: 2510 - RNA, 12 nt, Artificial
  siRNA construct
gcagaccaugcu

SEQ ID NO: 2511 - RNA, 12 nt, Artificial
  siRNA construct
cagaccaugcug

SEQ ID NO: 2512 - RNA, 12 nt, Artificial
  siRNA construct
agaccaugcuga

SEQ ID NO: 2513 - RNA, 12 nt, Artificial
  siRNA construct
gaccaugcugag

SEQ ID NO: 2514 - RNA, 12 nt, Artificial
  siRNA construct
accaugcugagc

SEQ ID NO: 2515 - RNA, 12 nt, Artificial
  siRNA construct
ccaugcugagca

SEQ ID NO: 2516 - RNA, 12 nt, Artificial
  siRNA construct
caugcugagcag

SEQ ID NO: 2517 - RNA, 12 nt, Artificial
  siRNA construct
augcugagcagc

SEQ ID NO: 2518 - RNA, 12 nt, Artificial
  siRNA construct
ugcugagcagcc

SEQ ID NO: 2519 - RNA, 12 nt, Artificial
  siRNA construct
gcugagcagcca

SEQ ID NO: 2520 - RNA, 12 nt, Artificial
  siRNA construct
cugagcagccac

SEQ ID NO: 2521 - RNA, 12 nt, Artificial
  siRNA construct
ugagcagccacg

SEQ ID NO: 2522 - RNA, 12 nt, Artificial
  siRNA construct
gagcagccacgg

SEQ ID NO: 2523 - RNA, 12 nt, Artificial
  siRNA construct
agcagccacggc

SEQ ID NO: 2524 - RNA, 12 nt, Artificial
  siRNA construct
gcagccacggcu

SEQ ID NO: 2525 - RNA, 12 nt, Artificial
  siRNA construct
cagccacggcuu

SEQ ID NO: 2526 - RNA, 12 nt, Artificial
  siRNA construct
agccacggcuuc

SEQ ID NO: 2527 - RNA, 12 nt, Artificial
  siRNA construct
gccacggcuuca

SEQ ID NO: 2528 - RNA, 12 nt, Artificial
  siRNA construct
ccacggcuucag

SEQ ID NO: 2529 - RNA, 12 nt, Artificial
  siRNA construct
cacggcuucagc

SEQ ID NO: 2530 - RNA, 12 nt, Artificial
  siRNA construct
acggcuucagcg

SEQ ID NO: 2531 - RNA, 12 nt, Artificial
  siRNA construct
cggcuucagcgu

SEQ ID NO: 2532 - RNA, 12 nt, Artificial
  siRNA construct
ggcuucagcgug

SEQ ID NO: 2533 - RNA, 12 nt, Artificial
  siRNA construct
gcuucagcgugg

SEQ ID NO: 2534 - RNA, 12 nt, Artificial
  siRNA construct
cuucagcgugga

SEQ ID NO: 2535 - RNA, 12 nt, Artificial
  siRNA construct
uucagcguggac

SEQ ID NO: 2536 - RNA, 12 nt, Artificial
  siRNA construct
ucagcguggaca

SEQ ID NO: 2537 - RNA, 12 nt, Artificial
  siRNA construct
cagcguggacac

SEQ ID NO: 2538 - RNA, 12 nt, Artificial
  siRNA construct
agcguggacacc

SEQ ID NO: 2539 - RNA, 12 nt, Artificial
  siRNA construct
gcguggacacca

SEQ ID NO: 2540 - RNA, 12 nt, Artificial
  siRNA construct
cccugcuggacc

SEQ ID NO: 2541 - RNA, 12 nt, Artificial
  siRNA construct
ccugcuggaccu

SEQ ID NO: 2542 - RNA, 12 nt, Artificial
  siRNA construct
cugcuggaccug

SEQ ID NO: 2543 - RNA, 12 nt, Artificial
  siRNA construct
ugcuggaccugu

SEQ ID NO: 2544 - RNA, 12 nt, Artificial
  siRNA construct
gcuggaccuguu

SEQ ID NO: 2545 - RNA, 12 nt, Artificial
  siRNA construct
cuggaccuguuc

SEQ ID NO: 2546 - RNA, 12 nt, Artificial
  siRNA construct
uggaccuguuca

SEQ ID NO: 2547 - RNA, 12 nt, Artificial
  siRNA construct
ggaccuguucag

SEQ ID NO: 2548 - RNA, 12 nt, Artificial
  siRNA construct
gaccuguucagc

SEQ ID NO: 2549 - RNA, 12 nt, Artificial
  siRNA construct
accuguucagcc

SEQ ID NO: 2550 - RNA, 12 nt, Artificial
  siRNA construct
ccucggugaccg

SEQ ID NO: 2551 - RNA, 12 nt, Artificial
  siRNA construct
cucggugaccgu

SEQ ID NO: 2552 - RNA, 12 nt, Artificial
  siRNA construct
ucggugaccgug

SEQ ID NO: 2553 - RNA, 12 nt, Artificial
  siRNA construct
cggugaccgugc

SEQ ID NO: 2554 - RNA, 12 nt, Artificial
  siRNA construct
ggugaccgugcc

SEQ ID NO: 2555 - RNA, 12 nt, Artificial
  siRNA construct
gugaccgugccc

SEQ ID NO: 2556 - RNA, 12 nt, Artificial
  siRNA construct
ugaccgugcccg

SEQ ID NO: 2557 - RNA, 12 nt, Artificial
  siRNA construct
gaccgugcccga

SEQ ID NO: 2558 - RNA, 12 nt, Artificial
  siRNA construct
accgugcccgac

SEQ ID NO: 2559 - RNA, 12 nt, Artificial
  siRNA construct
ccgugcccgaca

SEQ ID NO: 2560 - RNA, 12 nt, Artificial
  siRNA construct
cgugcccgacau

SEQ ID NO: 2561 - RNA, 12 nt, Artificial
  siRNA construct
gugcccgacaug

SEQ ID NO: 2562 - RNA, 12 nt, Artificial
  siRNA construct
ugcccgacauga

SEQ ID NO: 2563 - RNA, 12 nt, Artificial
  siRNA construct
gcccgacaugag

SEQ ID NO: 2564 - RNA, 12 nt, Artificial
  siRNA construct
cccgacaugagc

SEQ ID NO: 2565 - RNA, 12 nt, Artificial
  siRNA construct
ccgacaugagcc

SEQ ID NO: 2566 - RNA, 12 nt, Artificial
  siRNA construct
cgacaugagccu

SEQ ID NO: 2567 - RNA, 12 nt, Artificial
  siRNA construct
gacaugagccug

SEQ ID NO: 2568 - RNA, 12 nt, Artificial
  siRNA construct
acaugagccugc

SEQ ID NO: 2569 - RNA, 12 nt, Artificial
  siRNA construct
caugagccugcc

SEQ ID NO: 2570 - RNA, 12 nt, Artificial
  siRNA construct
augagccugccu

SEQ ID NO: 2571 - RNA, 12 nt, Artificial
  siRNA construct
ugagccugccug

SEQ ID NO: 2572 - RNA, 12 nt, Artificial
  siRNA construct
gagccugccuga

SEQ ID NO: 2573 - RNA, 12 nt, Artificial
  siRNA construct
agccugccugac

SEQ ID NO: 2574 - RNA, 12 nt, Artificial
  siRNA construct
gccugccugacc

SEQ ID NO: 2575 - RNA, 12 nt, Artificial
  siRNA construct
ccugccugaccu

SEQ ID NO: 2576 - RNA, 12 nt, Artificial
  siRNA construct
cugccugaccuu

SEQ ID NO: 2577 - RNA, 12 nt, Artificial
  siRNA construct
ugccugaccuug

SEQ ID NO: 2578 - RNA, 12 nt, Artificial
  siRNA construct
gccugaccuuga

SEQ ID NO: 2579 - RNA, 12 nt, Artificial
  siRNA construct
ccugaccuugac

SEQ ID NO: 2580 - RNA, 12 nt, Artificial
  siRNA construct
cugaccuugaca

SEQ ID NO: 2581 - RNA, 12 nt, Artificial
  siRNA construct
ugaccuugacag

SEQ ID NO: 2582 - RNA, 12 nt, Artificial
  siRNA construct
gaccuugacagc

SEQ ID NO: 2583 - RNA, 12 nt, Artificial
  siRNA construct
accuugacagca

SEQ ID NO: 2584 - RNA, 12 nt, Artificial
  siRNA construct
ccuugacagcag

SEQ ID NO: 2585 - RNA, 12 nt, Artificial
  siRNA construct
cuugacagcagc

SEQ ID NO: 2586 - RNA, 12 nt, Artificial
  siRNA construct
uugacagcagcc

SEQ ID NO: 2587 - RNA, 12 nt, Artificial
  siRNA construct
ugacagcagccu

SEQ ID NO: 2588 - RNA, 12 nt, Artificial
  siRNA construct
gacagcagccug

SEQ ID NO: 2589 - RNA, 12 nt, Artificial
  siRNA construct
acagcagccugg

SEQ ID NO: 2590 - RNA, 12 nt, Artificial
  siRNA construct
guauccaagagc

SEQ ID NO: 2591 - RNA, 12 nt, Artificial
  siRNA construct
uauccaagagcu

SEQ ID NO: 2592 - RNA, 12 nt, Artificial
  siRNA construct
auccaagagcuc

SEQ ID NO: 2593 - RNA, 12 nt, Artificial
  siRNA construct
uccaagagcucc

SEQ ID NO: 2594 - RNA, 12 nt, Artificial
  siRNA construct
ccaagagcuccu

SEQ ID NO: 2595 - RNA, 12 nt, Artificial
  siRNA construct
caagagcuccug

SEQ ID NO: 2596 - RNA, 12 nt, Artificial
  siRNA construct
aagagcuccugu

SEQ ID NO: 2597 - RNA, 12 nt, Artificial
  siRNA construct
agagcuccuguc

SEQ ID NO: 2598 - RNA, 12 nt, Artificial
  siRNA construct
gagcuccugucu

SEQ ID NO: 2599 - RNA, 12 nt, Artificial
  siRNA construct
agcuccugucuc

SEQ ID NO: 2600 - RNA, 12 nt, Artificial
  siRNA construct
gcuccugucucc

SEQ ID NO: 2601 - RNA, 12 nt, Artificial
  siRNA construct
gauucagggaag

SEQ ID NO: 2602 - RNA, 12 nt, Artificial
  siRNA construct
auucagggaagc

SEQ ID NO: 2603 - RNA, 12 nt, Artificial
  siRNA construct
uucagggaagca

SEQ ID NO: 2604 - RNA, 12 nt, Artificial
  siRNA construct
ucagggaagcag

SEQ ID NO: 2605 - RNA, 12 nt, Artificial
  siRNA construct
cagggaagcagc

SEQ ID NO: 2606 - RNA, 12 nt, Artificial
  siRNA construct
agggaagcagcu

SEQ ID NO: 2607 - RNA, 12 nt, Artificial
  siRNA construct
gggaagcagcug

SEQ ID NO: 2608 - RNA, 12 nt, Artificial
  siRNA construct
ggaagcagcugg

SEQ ID NO: 2609 - RNA, 12 nt, Artificial
  siRNA construct
ccggcuccgugg

SEQ ID NO: 2610 - RNA, 12 nt, Artificial
  siRNA construct
cggcuccgugga

SEQ ID NO: 2611 - RNA, 12 nt, Artificial
  siRNA construct
ggcuccguggac

SEQ ID NO: 2612 - RNA, 12 nt, Artificial
  siRNA construct
gcuccguggaca

SEQ ID NO: 2613 - RNA, 12 nt, Artificial
  siRNA construct
cuccguggacac

SEQ ID NO: 2614 - RNA, 12 nt, Artificial
  siRNA construct
uccguggacacc

SEQ ID NO: 2615 - RNA, 12 nt, Artificial
  siRNA construct
ccguggacaccg

SEQ ID NO: 2616 - RNA, 12 nt, Artificial
  siRNA construct
cguggacaccgg

SEQ ID NO: 2617 - RNA, 12 nt, Artificial
  siRNA construct
guggacaccggg

SEQ ID NO: 2618 - RNA, 12 nt, Artificial
  siRNA construct
uggacaccggga

SEQ ID NO: 2619 - RNA, 12 nt, Artificial
  siRNA construct
ggacaccgggag

SEQ ID NO: 2620 - RNA, 12 nt, Artificial
  siRNA construct
gacaccgggagc

SEQ ID NO: 2621 - RNA, 12 nt, Artificial
  siRNA construct
gccggugcuguu

SEQ ID NO: 2622 - RNA, 12 nt, Artificial
  siRNA construct
ccggugcuguuu

SEQ ID NO: 2623 - RNA, 12 nt, Artificial
  siRNA construct
cggugcuguuug

SEQ ID NO: 2624 - RNA, 12 nt, Artificial
  siRNA construct
ggugcuguuuga

SEQ ID NO: 2625 - RNA, 12 nt, Artificial
  siRNA construct
gugcuguuugag

SEQ ID NO: 2626 - RNA, 12 nt, Artificial
  siRNA construct
ugcuguuugagc

SEQ ID NO: 2627 - RNA, 12 nt, Artificial
  siRNA construct
gcuguuugagcu

SEQ ID NO: 2628 - RNA, 12 nt, Artificial
  siRNA construct
cuguuugagcug

SEQ ID NO: 2629 - RNA, 12 nt, Artificial
  siRNA construct
uguuugagcugg

SEQ ID NO: 2630 - RNA, 12 nt, Artificial
  siRNA construct
ccaccaucuccc

SEQ ID NO: 2631 - RNA, 12 nt, Artificial
  siRNA construct
caccaucucccu

SEQ ID NO: 2632 - RNA, 12 nt, Artificial
  siRNA construct
accaucucccug

SEQ ID NO: 2633 - RNA, 12 nt, Artificial
  siRNA construct
ccaucucccugc

SEQ ID NO: 2634 - RNA, 12 nt, Artificial
  siRNA construct
caucucccugcu

SEQ ID NO: 2635 - RNA, 12 nt, Artificial
  siRNA construct
aucucccugcug

SEQ ID NO: 2636 - RNA, 12 nt, Artificial
  siRNA construct
ucucccugcuga

SEQ ID NO: 2637 - RNA, 12 nt, Artificial
  siRNA construct
cucccugcugac

SEQ ID NO: 2638 - RNA, 12 nt, Artificial
  siRNA construct
cagguuguucau

SEQ ID NO: 2639 - RNA, 12 nt, Artificial
  siRNA construct
agguuguucaua

SEQ ID NO: 2640 - RNA, 12 nt, Artificial
  siRNA construct
gguuguucauag

SEQ ID NO: 2641 - RNA, 12 nt, Artificial
  siRNA construct
guuguucauagu

SEQ ID NO: 2642 - RNA, 12 nt, Artificial
  siRNA construct
uuguucauaguc

SEQ ID NO: 2643 - RNA, 12 nt, Artificial
  siRNA construct
uguucauaguca

SEQ ID NO: 2644 - RNA, 12 nt, Artificial
  siRNA construct
guucauagucag

SEQ ID NO: 2645 - RNA, 12 nt, Artificial
  siRNA construct
uucauagucaga

SEQ ID NO: 2646 - RNA, 12 nt, Artificial
  siRNA construct
aggccgggacgu

SEQ ID NO: 2647 - RNA, 12 nt, Artificial
  siRNA construct
aaggccgggacg

SEQ ID NO: 2648 - RNA, 12 nt, Artificial
  siRNA construct
gaaggccgggac

SEQ ID NO: 2649 - RNA, 12 nt, Artificial
  siRNA construct
ggaaggccggga

SEQ ID NO: 2650 - RNA, 12 nt, Artificial
  siRNA construct
aggaaggccggg

SEQ ID NO: 2651 - RNA, 12 nt, Artificial
  siRNA construct
caggaaggccgg

SEQ ID NO: 2652 - RNA, 12 nt, Artificial
  siRNA construct
ucaggaaggccg

SEQ ID NO: 2653 - RNA, 12 nt, Artificial
  siRNA construct
gucaggaaggcc

SEQ ID NO: 2654 - RNA, 12 nt, Artificial
  siRNA construct
ggucaggaaggc

SEQ ID NO: 2655 - RNA, 12 nt, Artificial
  siRNA construct
uggucaggaagg

SEQ ID NO: 2656 - RNA, 12 nt, Artificial
  siRNA construct
uuggucaggaag

SEQ ID NO: 2657 - RNA, 12 nt, Artificial
  siRNA construct
cuuggucaggaa

SEQ ID NO: 2658 - RNA, 12 nt, Artificial
  siRNA construct
gcuuggucagga

SEQ ID NO: 2659 - RNA, 12 nt, Artificial
  siRNA construct
agcuuggucagg

SEQ ID NO: 2660 - RNA, 12 nt, Artificial
  siRNA construct
cagcuuggucag

SEQ ID NO: 2661 - RNA, 12 nt, Artificial
  siRNA construct
acagcuugguca

SEQ ID NO: 2662 - RNA, 12 nt, Artificial
  siRNA construct
cacagcuugguc

SEQ ID NO: 2663 - RNA, 12 nt, Artificial
  siRNA construct
ccacagcuuggu

SEQ ID NO: 2664 - RNA, 12 nt, Artificial
  siRNA construct
uccacagcuugg

SEQ ID NO: 2665 - RNA, 12 nt, Artificial
  siRNA construct
guccacagcuug

SEQ ID NO: 2666 - RNA, 12 nt, Artificial
  siRNA construct
gguccacagcuu

SEQ ID NO: 2667 - RNA, 12 nt, Artificial
  siRNA construct
ggguccacagcu

SEQ ID NO: 2668 - RNA, 12 nt, Artificial
  siRNA construct
aggguccacagc

SEQ ID NO: 2669 - RNA, 12 nt, Artificial
  siRNA construct
gaggguccacag

SEQ ID NO: 2670 - RNA, 12 nt, Artificial
  siRNA construct
cgaggguccaca

SEQ ID NO: 2671 - RNA, 12 nt, Artificial
  siRNA construct
acgaggguccac

SEQ ID NO: 2672 - RNA, 12 nt, Artificial
  siRNA construct
cacgagggucca

SEQ ID NO: 2673 - RNA, 12 nt, Artificial
  siRNA construct
ucacgagggucc

SEQ ID NO: 2674 - RNA, 12 nt, Artificial
  siRNA construct
cucacgaggguc

SEQ ID NO: 2675 - RNA, 12 nt, Artificial
  siRNA construct
gcucacgagggu

SEQ ID NO: 2676 - RNA, 12 nt, Artificial
  siRNA construct
cgcucacgaggg

SEQ ID NO: 2677 - RNA, 12 nt, Artificial
  siRNA construct
ucgcucacgagg

SEQ ID NO: 2678 - RNA, 12 nt, Artificial
  siRNA construct
gucgcucacgag

SEQ ID NO: 2679 - RNA, 12 nt, Artificial
  siRNA construct
ggucgcucacga

SEQ ID NO: 2680 - RNA, 12 nt, Artificial
  siRNA construct
gggucgcucacg

SEQ ID NO: 2681 - RNA, 12 nt, Artificial
  siRNA construct
cgggucgcucac

SEQ ID NO: 2682 - RNA, 12 nt, Artificial
  siRNA construct
ccgggucgcuca

SEQ ID NO: 2683 - RNA, 12 nt, Artificial
  siRNA construct
uccgggucgcuc

SEQ ID NO: 2684 - RNA, 12 nt, Artificial
  siRNA construct
guccgggucgcu

SEQ ID NO: 2685 - RNA, 12 nt, Artificial
  siRNA construct
uguccgggucgc

SEQ ID NO: 2686 - RNA, 12 nt, Artificial
  siRNA construct
guguccgggucg

SEQ ID NO: 2687 - RNA, 12 nt, Artificial
  siRNA construct
gguguccggguc

SEQ ID NO: 2688 - RNA, 12 nt, Artificial
  siRNA construct
cgguguccgggu

SEQ ID NO: 2689 - RNA, 12 nt, Artificial
  siRNA construct
uccagcagauga

SEQ ID NO: 2690 - RNA, 12 nt, Artificial
  siRNA construct
cuccagcagaug

SEQ ID NO: 2691 - RNA, 12 nt, Artificial
  siRNA construct
gcuccagcagau

SEQ ID NO: 2692 - RNA, 12 nt, Artificial
  siRNA construct
ggcuccagcaga

SEQ ID NO: 2693 - RNA, 12 nt, Artificial
  siRNA construct
gggcuccagcag

SEQ ID NO: 2694 - RNA, 12 nt, Artificial
  siRNA construct
cgggcuccagca

SEQ ID NO: 2695 - RNA, 12 nt, Artificial
  siRNA construct
ucgggcuccagc

SEQ ID NO: 2696 - RNA, 12 nt, Artificial
  siRNA construct
ccuggucgaaca

SEQ ID NO: 2697 - RNA, 12 nt, Artificial
  siRNA construct
cccuggucgaac

SEQ ID NO: 2698 - RNA, 12 nt, Artificial
  siRNA construct
gcccuggucgaa

SEQ ID NO: 2699 - RNA, 12 nt, Artificial
  siRNA construct
ggcccuggucga

SEQ ID NO: 2700 - RNA, 12 nt, Artificial
  siRNA construct
uggcccuggucg

SEQ ID NO: 2701 - RNA, 12 nt, Artificial
  siRNA construct
cuggcccugguc

SEQ ID NO: 2702 - RNA, 12 nt, Artificial
  siRNA construct
acuggcccuggu

SEQ ID NO: 2703 - RNA, 12 nt, Artificial
  siRNA construct
aacuggcccugg

SEQ ID NO: 2704 - RNA, 12 nt, Artificial
  siRNA construct
aaacuggcccug

SEQ ID NO: 2705 - RNA, 12 nt, Artificial
  siRNA construct
caaacuggcccu

SEQ ID NO: 2706 - RNA, 12 nt, Artificial
  siRNA construct
gcaaacuggccc

SEQ ID NO: 2707 - RNA, 12 nt, Artificial
  siRNA construct
ggcaaacuggcc

SEQ ID NO: 2708 - RNA, 12 nt, Artificial
  siRNA construct
uggcaaacuggc

SEQ ID NO: 2709 - RNA, 12 nt, Artificial
  siRNA construct
uuggcaaacugg

SEQ ID NO: 2710 - RNA, 12 nt, Artificial
  siRNA construct
cuuggcaaacug

SEQ ID NO: 2711 - RNA, 12 nt, Artificial
  siRNA construct
ccuuggcaaacu

SEQ ID NO: 2712 - RNA, 12 nt, Artificial
  siRNA construct
uccuuggcaaac

SEQ ID NO: 2713 - RNA, 12 nt, Artificial
  siRNA construct
cuccuuggcaaa

SEQ ID NO: 2714 - RNA, 12 nt, Artificial
  siRNA construct
ccuccuuggcaa

SEQ ID NO: 2715 - RNA, 12 nt, Artificial
  siRNA construct
accuccuuggca

SEQ ID NO: 2716 - RNA, 12 nt, Artificial
  siRNA construct
caccuccuuggc

SEQ ID NO: 2717 - RNA, 12 nt, Artificial
  siRNA construct
gcaccuccuugg

SEQ ID NO: 2718 - RNA, 12 nt, Artificial
  siRNA construct
agcaccuccuug

SEQ ID NO: 2719 - RNA, 12 nt, Artificial
  siRNA construct
cagcaccuccuu

SEQ ID NO: 2720 - RNA, 12 nt, Artificial
  siRNA construct
gcagcaccuccu

SEQ ID NO: 2721 - RNA, 12 nt, Artificial
  siRNA construct
ggcagcaccucc

SEQ ID NO: 2722 - RNA, 12 nt, Artificial
  siRNA construct
gggcagcaccuc

SEQ ID NO: 2723 - RNA, 12 nt, Artificial
  siRNA construct
ugggcagcaccu

SEQ ID NO: 2724 - RNA, 12 nt, Artificial
  siRNA construct
uugggcagcacc

SEQ ID NO: 2725 - RNA, 12 nt, Artificial
  siRNA construct
cuugggcagcac

SEQ ID NO: 2726 - RNA, 12 nt, Artificial
  siRNA construct
acuugggcagca

SEQ ID NO: 2727 - RNA, 12 nt, Artificial
  siRNA construct
gaaguacuuggg

SEQ ID NO: 2728 - RNA, 12 nt, Artificial
  siRNA construct
ugaaguacuugg

SEQ ID NO: 2729 - RNA, 12 nt, Artificial
  siRNA construct
uugaaguacuug

SEQ ID NO: 2730 - RNA, 12 nt, Artificial
  siRNA construct
cuugaaguacuu

SEQ ID NO: 2731 - RNA, 12 nt, Artificial
  siRNA construct
gcuugaaguacu

SEQ ID NO: 2732 - RNA, 12 nt, Artificial
  siRNA construct
ugcuugaaguac

SEQ ID NO: 2733 - RNA, 12 nt, Artificial
  siRNA construct
gugcuugaagua

SEQ ID NO: 2734 - RNA, 12 nt, Artificial
  siRNA construct
ugugcuugaagu

SEQ ID NO: 2735 - RNA, 12 nt, Artificial
  siRNA construct
uguugugcuuga

SEQ ID NO: 2736 - RNA, 12 nt, Artificial
  siRNA construct
uuguugugcuug

SEQ ID NO: 2737 - RNA, 12 nt, Artificial
  siRNA construct
guuguugugcuu

SEQ ID NO: 2738 - RNA, 12 nt, Artificial
  siRNA construct
uguuguugugcu

SEQ ID NO: 2739 - RNA, 12 nt, Artificial
  siRNA construct
auguuguugugc

SEQ ID NO: 2740 - RNA, 12 nt, Artificial
  siRNA construct
cauguuguugug

SEQ ID NO: 2741 - RNA, 12 nt, Artificial
  siRNA construct
ccauguuguugu

SEQ ID NO: 2742 - RNA, 12 nt, Artificial
  siRNA construct
gccauguuguug

SEQ ID NO: 2743 - RNA, 12 nt, Artificial
  siRNA construct
ggccauguuguu

SEQ ID NO: 2744 - RNA, 12 nt, Artificial
  siRNA construct
uggccauguugu

SEQ ID NO: 2745 - RNA, 12 nt, Artificial
  siRNA construct
cuggccauguug

SEQ ID NO: 2746 - RNA, 12 nt, Artificial
  siRNA construct
gcuggccauguu

SEQ ID NO: 2747 - RNA, 12 nt, Artificial
  siRNA construct
agcuggccaugu

SEQ ID NO: 2748 - RNA, 12 nt, Artificial
  siRNA construct
aagcuggccaug

SEQ ID NO: 2749 - RNA, 12 nt, Artificial
  siRNA construct
gaagcuggccau

SEQ ID NO: 2750 - RNA, 12 nt, Artificial
  siRNA construct
cgaagcuggcca

SEQ ID NO: 2751 - RNA, 12 nt, Artificial
  siRNA construct
acgaagcuggcc

SEQ ID NO: 2752 - RNA, 12 nt, Artificial
  siRNA construct
cacgaagcuggc

SEQ ID NO: 2753 - RNA, 12 nt, Artificial
  siRNA construct
gcacgaagcugg

SEQ ID NO: 2754 - RNA, 12 nt, Artificial
  siRNA construct
cgcacgaagcug

SEQ ID NO: 2755 - RNA, 12 nt, Artificial
  siRNA construct
ccgcacgaagcu

SEQ ID NO: 2756 - RNA, 12 nt, Artificial
  siRNA construct
gccgcacgaagc

SEQ ID NO: 2757 - RNA, 12 nt, Artificial
  siRNA construct
gcugcuccuggc

SEQ ID NO: 2758 - RNA, 12 nt, Artificial
  siRNA construct
agcugcuccugg

SEQ ID NO: 2759 - RNA, 12 nt, Artificial
  siRNA construct
gagcugcuccug

SEQ ID NO: 2760 - RNA, 12 nt, Artificial
  siRNA construct
ggagcugcuccu

SEQ ID NO: 2761 - RNA, 12 nt, Artificial
  siRNA construct
aggagcugcucc

SEQ ID NO: 2762 - RNA, 12 nt, Artificial
  siRNA construct
aaggagcugcuc

SEQ ID NO: 2763 - RNA, 12 nt, Artificial
  siRNA construct
caaggagcugcu

SEQ ID NO: 2764 - RNA, 12 nt, Artificial
  siRNA construct
ucaaggagcugc

SEQ ID NO: 2765 - RNA, 12 nt, Artificial
  siRNA construct
cucaaggagcug

SEQ ID NO: 2766 - RNA, 12 nt, Artificial
  siRNA construct
ucucaaggagcu

SEQ ID NO: 2767 - RNA, 12 nt, Artificial
  siRNA construct
uucucaaggagc

SEQ ID NO: 2768 - RNA, 12 nt, Artificial
  siRNA construct
guucucaaggag

SEQ ID NO: 2769 - RNA, 12 nt, Artificial
  siRNA construct
uguucucaagga

SEQ ID NO: 2770 - RNA, 12 nt, Artificial
  siRNA construct
auguucucaagg

SEQ ID NO: 2771 - RNA, 12 nt, Artificial
  siRNA construct
gauguucucaag

SEQ ID NO: 2772 - RNA, 12 nt, Artificial
  siRNA construct
ugauguucucaa

SEQ ID NO: 2773 - RNA, 12 nt, Artificial
  siRNA construct
uugauguucuca

SEQ ID NO: 2774 - RNA, 12 nt, Artificial
  siRNA construct
cuugauguucuc

SEQ ID NO: 2775 - RNA, 12 nt, Artificial
  siRNA construct
ucuugauguucu

SEQ ID NO: 2776 - RNA, 12 nt, Artificial
  siRNA construct
cucuugauguuc

SEQ ID NO: 2777 - RNA, 12 nt, Artificial
  siRNA construct
ccucuugauguu

SEQ ID NO: 2778 - RNA, 12 nt, Artificial
  siRNA construct
uccucuugaugu

SEQ ID NO: 2779 - RNA, 12 nt, Artificial
  siRNA construct
uuccucuugaug

SEQ ID NO: 2780 - RNA, 12 nt, Artificial
  siRNA construct
uuuccucuugau

SEQ ID NO: 2781 - RNA, 12 nt, Artificial
  siRNA construct
cuuuccucuuga

SEQ ID NO: 2782 - RNA, 12 nt, Artificial
  siRNA construct
acuuuccucuug

SEQ ID NO: 2783 - RNA, 12 nt, Artificial
  siRNA construct
cacuuuccucuu

SEQ ID NO: 2784 - RNA, 12 nt, Artificial
  siRNA construct
ucacuuuccucu

SEQ ID NO: 2785 - RNA, 12 nt, Artificial
  siRNA construct
gucacuuuccuc

SEQ ID NO: 2786 - RNA, 12 nt, Artificial
  siRNA construct
ggucacuuuccu

SEQ ID NO: 2787 - RNA, 12 nt, Artificial
  siRNA construct
uggucacuuucc

SEQ ID NO: 2788 - RNA, 12 nt, Artificial
  siRNA construct
cuggucacuuuc

SEQ ID NO: 2789 - RNA, 12 nt, Artificial
  siRNA construct
acuggucacuuu

SEQ ID NO: 2790 - RNA, 12 nt, Artificial
  siRNA construct
cacuggucacuu

SEQ ID NO: 2791 - RNA, 12 nt, Artificial
  siRNA construct
acacuggucacu

SEQ ID NO: 2792 - RNA, 12 nt, Artificial
  siRNA construct
cacacuggucac

SEQ ID NO: 2793 - RNA, 12 nt, Artificial
  siRNA construct
acacacugguca

SEQ ID NO: 2794 - RNA, 12 nt, Artificial
  siRNA construct
gacacacugguc

SEQ ID NO: 2795 - RNA, 12 nt, Artificial
  siRNA construct
ggacacacuggu

SEQ ID NO: 2796 - RNA, 12 nt, Artificial
  siRNA construct
uggacacacugg

SEQ ID NO: 2797 - RNA, 12 nt, Artificial
  siRNA construct
guggacacacug

SEQ ID NO: 2798 - RNA, 12 nt, Artificial
  siRNA construct
gguggacacacu

SEQ ID NO: 2799 - RNA, 12 nt, Artificial
  siRNA construct
ggguggacacac

SEQ ID NO: 2800 - RNA, 12 nt, Artificial
  siRNA construct
aggguggacaca

SEQ ID NO: 2801 - RNA, 12 nt, Artificial
  siRNA construct
caggguggacac

SEQ ID NO: 2802 - RNA, 12 nt, Artificial
  siRNA construct
ucaggguggaca

SEQ ID NO: 2803 - RNA, 12 nt, Artificial
  siRNA construct
uucaggguggac

SEQ ID NO: 2804 - RNA, 12 nt, Artificial
  siRNA construct
cuucagggugga

SEQ ID NO: 2805 - RNA, 12 nt, Artificial
  siRNA construct
ucuucagggugg

SEQ ID NO: 2806 - RNA, 12 nt, Artificial
  siRNA construct
cucuucagggug

SEQ ID NO: 2807 - RNA, 12 nt, Artificial
  siRNA construct
acucuucagggu

SEQ ID NO: 2808 - RNA, 12 nt, Artificial
  siRNA construct
cacucuucaggg

SEQ ID NO: 2809 - RNA, 12 nt, Artificial
  siRNA construct
ucacucuucagg

SEQ ID NO: 2810 - RNA, 12 nt, Artificial
  siRNA construct
uucacucuucag

SEQ ID NO: 2811 - RNA, 12 nt, Artificial
  siRNA construct
cuucacucuuca

SEQ ID NO: 2812 - RNA, 12 nt, Artificial
  siRNA construct
ucuucacucuuc

SEQ ID NO: 2813 - RNA, 12 nt, Artificial
  siRNA construct
gucuucacucuu

SEQ ID NO: 2814 - RNA, 12 nt, Artificial
  siRNA construct
ugucuucacucu

SEQ ID NO: 2815 - RNA, 12 nt, Artificial
  siRNA construct
augucuucacuc

SEQ ID NO: 2816 - RNA, 12 nt, Artificial
  siRNA construct
uaugucuucacu

SEQ ID NO: 2817 - RNA, 12 nt, Artificial
  siRNA construct
uuaugucuucac

SEQ ID NO: 2818 - RNA, 12 nt, Artificial
  siRNA construct
uuuaugucuuca

SEQ ID NO: 2819 - RNA, 12 nt, Artificial
  siRNA construct
cuuuaugucuuc

SEQ ID NO: 2820 - RNA, 12 nt, Artificial
  siRNA construct
ucuuuaugucuu

SEQ ID NO: 2821 - RNA, 12 nt, Artificial
  siRNA construct
aucuuuaugucu

SEQ ID NO: 2822 - RNA, 12 nt, Artificial
  siRNA construct
gaucuuuauguc

SEQ ID NO: 2823 - RNA, 12 nt, Artificial
  siRNA construct
ggaucuuuaugu

SEQ ID NO: 2824 - RNA, 12 nt, Artificial
  siRNA construct
gcagcuugguga

SEQ ID NO: 2825 - RNA, 12 nt, Artificial
  siRNA construct
agcagcuuggug

SEQ ID NO: 2826 - RNA, 12 nt, Artificial
  siRNA construct
cagcagcuuggu

SEQ ID NO: 2827 - RNA, 12 nt, Artificial
  siRNA construct
ucagcagcuugg

SEQ ID NO: 2828 - RNA, 12 nt, Artificial
  siRNA construct
gucagcagcuug

SEQ ID NO: 2829 - RNA, 12 nt, Artificial
  siRNA construct
cgucagcagcuu

SEQ ID NO: 2830 - RNA, 12 nt, Artificial
  siRNA construct
ccgucagcagcu

SEQ ID NO: 2831 - RNA, 12 nt, Artificial
  siRNA construct
uccgucagcagc

SEQ ID NO: 2832 - RNA, 12 nt, Artificial
  siRNA construct
guccgucagcag

SEQ ID NO: 2833 - RNA, 12 nt, Artificial
  siRNA construct
cguccgucagca

SEQ ID NO: 2834 - RNA, 12 nt, Artificial
  siRNA construct
acguccgucagc

SEQ ID NO: 2835 - RNA, 12 nt, Artificial
  siRNA construct
cacguccgucag

SEQ ID NO: 2836 - RNA, 12 nt, Artificial
  siRNA construct
gcacguccguca

SEQ ID NO: 2837 - RNA, 12 nt, Artificial
  siRNA construct
ugcacguccguc

SEQ ID NO: 2838 - RNA, 12 nt, Artificial
  siRNA construct
cugcacguccgu

SEQ ID NO: 2839 - RNA, 12 nt, Artificial
  siRNA construct
gcugcacguccg

SEQ ID NO: 2840 - RNA, 12 nt, Artificial
  siRNA construct
agcugcacgucc

SEQ ID NO: 2841 - RNA, 12 nt, Artificial
  siRNA construct
cagcugcacguc

SEQ ID NO: 2842 - RNA, 12 nt, Artificial
  siRNA construct
ucagcugcacgu

SEQ ID NO: 2843 - RNA, 12 nt, Artificial
  siRNA construct
aucagcugcacg

SEQ ID NO: 2844 - RNA, 12 nt, Artificial
  siRNA construct
caucagcugcac

SEQ ID NO: 2845 - RNA, 12 nt, Artificial
  siRNA construct
ucaucagcugca

SEQ ID NO: 2846 - RNA, 12 nt, Artificial
  siRNA construct
uucaucagcugc

SEQ ID NO: 2847 - RNA, 12 nt, Artificial
  siRNA construct
cuucaucagcug

SEQ ID NO: 2848 - RNA, 12 nt, Artificial
  siRNA construct
ccuucaucagcu

SEQ ID NO: 2849 - RNA, 12 nt, Artificial
  siRNA construct
gagccucauucu

SEQ ID NO: 2850 - RNA, 12 nt, Artificial
  siRNA construct
agagccucauuc

SEQ ID NO: 2851 - RNA, 12 nt, Artificial
  siRNA construct
cagagccucauu

SEQ ID NO: 2852 - RNA, 12 nt, Artificial
  siRNA construct
acagagccucau

SEQ ID NO: 2853 - RNA, 12 nt, Artificial
  siRNA construct
cacagagccuca

SEQ ID NO: 2854 - RNA, 12 nt, Artificial
  siRNA construct
ccacagagccuc

SEQ ID NO: 2855 - RNA, 12 nt, Artificial
  siRNA construct
gccacagagccu

SEQ ID NO: 2856 - RNA, 12 nt, Artificial
  siRNA construct
cgccacagagcc

SEQ ID NO: 2857 - RNA, 12 nt, Artificial
  siRNA construct
ccgccacagagc

SEQ ID NO: 2858 - RNA, 12 nt, Artificial
  siRNA construct
cccgccacagag

SEQ ID NO: 2859 - RNA, 12 nt, Artificial
  siRNA construct
ucccgccacaga

SEQ ID NO: 2860 - RNA, 12 nt, Artificial
  siRNA construct
cucccgccacag

SEQ ID NO: 2861 - RNA, 12 nt, Artificial
  siRNA construct
ccucccgccaca

SEQ ID NO: 2862 - RNA, 12 nt, Artificial
  siRNA construct
accucccgccac

SEQ ID NO: 2863 - RNA, 12 nt, Artificial
  siRNA construct
caccucccgcca

SEQ ID NO: 2864 - RNA, 12 nt, Artificial
  siRNA construct
ccaccucccgcc

SEQ ID NO: 2865 - RNA, 12 nt, Artificial
  siRNA construct
gccaccucccgc

SEQ ID NO: 2866 - RNA, 12 nt, Artificial
  siRNA construct
ggccaccucccg

SEQ ID NO: 2867 - RNA, 12 nt, Artificial
  siRNA construct
uggccaccuccc

SEQ ID NO: 2868 - RNA, 12 nt, Artificial
  siRNA construct
cuggccaccucc

SEQ ID NO: 2869 - RNA, 12 nt, Artificial
  siRNA construct
gcuggccaccuc

SEQ ID NO: 2870 - RNA, 12 nt, Artificial
  siRNA construct
ggcuggccaccu

SEQ ID NO: 2871 - RNA, 12 nt, Artificial
  siRNA construct
aggcuggccacc

SEQ ID NO: 2872 - RNA, 12 nt, Artificial
  siRNA construct
aaggcuggccac

SEQ ID NO: 2873 - RNA, 12 nt, Artificial
  siRNA construct
gaaggcuggcca

SEQ ID NO: 2874 - RNA, 12 nt, Artificial
  siRNA construct
cgaaggcuggcc

SEQ ID NO: 2875 - RNA, 12 nt, Artificial
  siRNA construct
ccgaaggcuggc

SEQ ID NO: 2876 - RNA, 12 nt, Artificial
  siRNA construct
gccgaaggcugg

SEQ ID NO: 2877 - RNA, 12 nt, Artificial
  siRNA construct
ugccgaaggcug

SEQ ID NO: 2878 - RNA, 12 nt, Artificial
  siRNA construct
cugccgaaggcu

SEQ ID NO: 2879 - RNA, 12 nt, Artificial
  siRNA construct
ucugccgaaggc

SEQ ID NO: 2880 - RNA, 12 nt, Artificial
  siRNA construct
uucugccgaagg

SEQ ID NO: 2881 - RNA, 12 nt, Artificial
  siRNA construct
cuucugccgaag

SEQ ID NO: 2882 - RNA, 12 nt, Artificial
  siRNA construct
gcuucugccgaa

SEQ ID NO: 2883 - RNA, 12 nt, Artificial
  siRNA construct
ugcuucugccga

SEQ ID NO: 2884 - RNA, 12 nt, Artificial
  siRNA construct
augcuucugccg

SEQ ID NO: 2885 - RNA, 12 nt, Artificial
  siRNA construct
caugcuucugcc

SEQ ID NO: 2886 - RNA, 12 nt, Artificial
  siRNA construct
gcaugcuucugc

SEQ ID NO: 2887 - RNA, 12 nt, Artificial
  siRNA construct
ggcaugcuucug

SEQ ID NO: 2888 - RNA, 12 nt, Artificial
  siRNA construct
gggcaugcuucu

SEQ ID NO: 2889 - RNA, 12 nt, Artificial
  siRNA construct
ugggcaugcuuc

SEQ ID NO: 2890 - RNA, 12 nt, Artificial
  siRNA construct
cugggcaugcuu

SEQ ID NO: 2891 - RNA, 12 nt, Artificial
  siRNA construct
gcugggcaugcu

SEQ ID NO: 2892 - RNA, 12 nt, Artificial
  siRNA construct
ugcugggcaugc

SEQ ID NO: 2893 - RNA, 12 nt, Artificial
  siRNA construct
uugcugggcaug

SEQ ID NO: 2894 - RNA, 12 nt, Artificial
  siRNA construct
guugcugggcau

SEQ ID NO: 2895 - RNA, 12 nt, Artificial
  siRNA construct
uguugcugggca

SEQ ID NO: 2896 - RNA, 12 nt, Artificial
  siRNA construct
cuguugcugggc

SEQ ID NO: 2897 - RNA, 12 nt, Artificial
  siRNA construct
ucuguugcuggg

SEQ ID NO: 2898 - RNA, 12 nt, Artificial
  siRNA construct
uucuguugcugg

SEQ ID NO: 2899 - RNA, 12 nt, Artificial
  siRNA construct
uuucuguugcug

SEQ ID NO: 2900 - RNA, 12 nt, Artificial
  siRNA construct
cuuucuguugcu

SEQ ID NO: 2901 - RNA, 12 nt, Artificial
  siRNA construct
acuuucuguugc

SEQ ID NO: 2902 - RNA, 12 nt, Artificial
  siRNA construct
cugaaugagcuu

SEQ ID NO: 2903 - RNA, 12 nt, Artificial
  siRNA construct
acugaaugagcu

SEQ ID NO: 2904 - RNA, 12 nt, Artificial
  siRNA construct
aacugaaugagc

SEQ ID NO: 2905 - RNA, 12 nt, Artificial
  siRNA construct
gaacugaaugag

SEQ ID NO: 2906 - RNA, 12 nt, Artificial
  siRNA construct
ggaacugaauga

SEQ ID NO: 2907 - RNA, 12 nt, Artificial
  siRNA construct
aggaacugaaug

SEQ ID NO: 2908 - RNA, 12 nt, Artificial
  siRNA construct
caggaacugaau

SEQ ID NO: 2909 - RNA, 12 nt, Artificial
  siRNA construct
ucaggaacugaa

SEQ ID NO: 2910 - RNA, 12 nt, Artificial
  siRNA construct
aucaggaacuga

SEQ ID NO: 2911 - RNA, 12 nt, Artificial
  siRNA construct
gaucaggaacug

SEQ ID NO: 2912 - RNA, 12 nt, Artificial
  siRNA construct
agaucaggaacu

SEQ ID NO: 2913 - RNA, 12 nt, Artificial
  siRNA construct
gagaucaggaac

SEQ ID NO: 2914 - RNA, 12 nt, Artificial
  siRNA construct
ugagaucaggaa

SEQ ID NO: 2915 - RNA, 12 nt, Artificial
  siRNA construct
gugagaucagga

SEQ ID NO: 2916 - RNA, 12 nt, Artificial
  siRNA construct
agugagaucagg

SEQ ID NO: 2917 - RNA, 12 nt, Artificial
  siRNA construct
cagugagaucag

SEQ ID NO: 2918 - RNA, 12 nt, Artificial
  siRNA construct
ccagugagauca

SEQ ID NO: 2919 - RNA, 12 nt, Artificial
  siRNA construct
accagugagauc

SEQ ID NO: 2920 - RNA, 12 nt, Artificial
  siRNA construct
caccagugagau

SEQ ID NO: 2921 - RNA, 12 nt, Artificial
  siRNA construct
gcaccagugaga

SEQ ID NO: 2922 - RNA, 12 nt, Artificial
  siRNA construct
ugcaccagugag

SEQ ID NO: 2923 - RNA, 12 nt, Artificial
  siRNA construct
cugcaccaguga

SEQ ID NO: 2924 - RNA, 12 nt, Artificial
  siRNA construct
acugcaccagug

SEQ ID NO: 2925 - RNA, 12 nt, Artificial
  siRNA construct
gacugcaccagu

SEQ ID NO: 2926 - RNA, 12 nt, Artificial
  siRNA construct
ugacugcaccag

SEQ ID NO: 2927 - RNA, 12 nt, Artificial
  siRNA construct
uugacugcacca

SEQ ID NO: 2928 - RNA, 12 nt, Artificial
  siRNA construct
uuugacugcacc

SEQ ID NO: 2929 - RNA, 12 nt, Artificial
  siRNA construct
guuugacugcac

SEQ ID NO: 2930 - RNA, 12 nt, Artificial
  siRNA construct
gguuugacugca

SEQ ID NO: 2931 - RNA, 12 nt, Artificial
  siRNA construct
cgguuugacugc

SEQ ID NO: 2932 - RNA, 12 nt, Artificial
  siRNA construct
ccgguuugacug

SEQ ID NO: 2933 - RNA, 12 nt, Artificial
  siRNA construct
uccgguuugacu

SEQ ID NO: 2934 - RNA, 12 nt, Artificial
  siRNA construct
auccgguuugac

SEQ ID NO: 2935 - RNA, 12 nt, Artificial
  siRNA construct
gauccgguuuga

SEQ ID NO: 2936 - RNA, 12 nt, Artificial
  siRNA construct
ggauccgguuug

SEQ ID NO: 2937 - RNA, 12 nt, Artificial
  siRNA construct
aggauccgguuu

SEQ ID NO: 2938 - RNA, 12 nt, Artificial
  siRNA construct
caggauccgguu

SEQ ID NO: 2939 - RNA, 12 nt, Artificial
  siRNA construct
ccaggauccggu

SEQ ID NO: 2940 - RNA, 12 nt, Artificial
  siRNA construct
uucagcaucagg

SEQ ID NO: 2941 - RNA, 12 nt, Artificial
  siRNA construct
guucagcaucag

SEQ ID NO: 2942 - RNA, 12 nt, Artificial
  siRNA construct
cguucagcauca

SEQ ID NO: 2943 - RNA, 12 nt, Artificial
  siRNA construct
ucguucagcauc

SEQ ID NO: 2944 - RNA, 12 nt, Artificial
  siRNA construct
gucguucagcau

SEQ ID NO: 2945 - RNA, 12 nt, Artificial
  siRNA construct
ugucguucagca

SEQ ID NO: 2946 - RNA, 12 nt, Artificial
  siRNA construct
cugucguucagc

SEQ ID NO: 2947 - RNA, 12 nt, Artificial
  siRNA construct
acugucguucag

SEQ ID NO: 2948 - RNA, 12 nt, Artificial
  siRNA construct
cacugucguuca

SEQ ID NO: 2949 - RNA, 12 nt, Artificial
  siRNA construct
ccacugucguuc

SEQ ID NO: 2950 - RNA, 12 nt, Artificial
  siRNA construct
gccacugucguu

SEQ ID NO: 2951 - RNA, 12 nt, Artificial
  siRNA construct
agccacugucgu

SEQ ID NO: 2952 - RNA, 12 nt, Artificial
  siRNA construct
gagccacugucg

SEQ ID NO: 2953 - RNA, 12 nt, Artificial
  siRNA construct
ugagccacuguc

SEQ ID NO: 2954 - RNA, 12 nt, Artificial
  siRNA construct
cugagccacugu

SEQ ID NO: 2955 - RNA, 12 nt, Artificial
  siRNA construct
gcugagccacug

SEQ ID NO: 2956 - RNA, 12 nt, Artificial
  siRNA construct
ugcugagccacu

SEQ ID NO: 2957 - RNA, 12 nt, Artificial
  siRNA construct
gugcugagccac

SEQ ID NO: 2958 - RNA, 12 nt, Artificial
  siRNA construct
ugugcugagcca

SEQ ID NO: 2959 - RNA, 12 nt, Artificial
  siRNA construct
augugcugagcc

SEQ ID NO: 2960 - RNA, 12 nt, Artificial
  siRNA construct
aaugugcugagc

SEQ ID NO: 2961 - RNA, 12 nt, Artificial
  siRNA construct
gaaugugcugag

SEQ ID NO: 2962 - RNA, 12 nt, Artificial
  siRNA construct
ggaaugugcuga

SEQ ID NO: 2963 - RNA, 12 nt, Artificial
  siRNA construct
uggaaugugcug

SEQ ID NO: 2964 - RNA, 12 nt, Artificial
  siRNA construct
auggaaugugcu

SEQ ID NO: 2965 - RNA, 12 nt, Artificial
  siRNA construct
cauggaaugugc

SEQ ID NO: 2966 - RNA, 12 nt, Artificial
  siRNA construct
gcauggaaugug

SEQ ID NO: 2967 - RNA, 12 nt, Artificial
  siRNA construct
ggcauggaaugu

SEQ ID NO: 2968 - RNA, 12 nt, Artificial
  siRNA construct
gggcauggaaug

SEQ ID NO: 2969 - RNA, 12 nt, Artificial
  siRNA construct
ugggcauggaau

SEQ ID NO: 2970 - RNA, 12 nt, Artificial
  siRNA construct
uugggcauggaa

SEQ ID NO: 2971 - RNA, 12 nt, Artificial
  siRNA construct
cuugggcaugga

SEQ ID NO: 2972 - RNA, 12 nt, Artificial
  siRNA construct
acuugggcaugg

SEQ ID NO: 2973 - RNA, 12 nt, Artificial
  siRNA construct
uacuugggcaug

SEQ ID NO: 2974 - RNA, 12 nt, Artificial
  siRNA construct
gagaacugccgg

SEQ ID NO: 2975 - RNA, 12 nt, Artificial
  siRNA construct
ggagaacugccg

SEQ ID NO: 2976 - RNA, 12 nt, Artificial
  siRNA construct
gggagaacugcc

SEQ ID NO: 2977 - RNA, 12 nt, Artificial
  siRNA construct
agggagaacugc

SEQ ID NO: 2978 - RNA, 12 nt, Artificial
  siRNA construct
cagggagaacug

SEQ ID NO: 2979 - RNA, 12 nt, Artificial
  siRNA construct
ccagggagaacu

SEQ ID NO: 2980 - RNA, 12 nt, Artificial
  siRNA construct
uccagggagaac

SEQ ID NO: 2981 - RNA, 12 nt, Artificial
  siRNA construct
cuccagggagaa

SEQ ID NO: 2982 - RNA, 12 nt, Artificial
  siRNA construct
gcuccagggaga

SEQ ID NO: 2983 - RNA, 12 nt, Artificial
  siRNA construct
ugcuccagggag

SEQ ID NO: 2984 - RNA, 12 nt, Artificial
  siRNA construct
gugcuccaggga

SEQ ID NO: 2985 - RNA, 12 nt, Artificial
  siRNA construct
cgugcuccaggg

SEQ ID NO: 2986 - RNA, 12 nt, Artificial
  siRNA construct
acgugcuccagg

SEQ ID NO: 2987 - RNA, 12 nt, Artificial
  siRNA construct
gacgugcuccag

SEQ ID NO: 2988 - RNA, 12 nt, Artificial
  siRNA construct
ggacgugcucca

SEQ ID NO: 2989 - RNA, 12 nt, Artificial
  siRNA construct
uggacgugcucc

SEQ ID NO: 2990 - RNA, 12 nt, Artificial
  siRNA construct
guggacgugcuc

SEQ ID NO: 2991 - RNA, 12 nt, Artificial
  siRNA construct
cguggacgugcu

SEQ ID NO: 2992 - RNA, 12 nt, Artificial
  siRNA construct
ccguggacgugc

SEQ ID NO: 2993 - RNA, 12 nt, Artificial
  siRNA construct
gccguggacgug

SEQ ID NO: 2994 - RNA, 12 nt, Artificial
  siRNA construct
agccguggacgu

SEQ ID NO: 2995 - RNA, 12 nt, Artificial
  siRNA construct
ggugaugucgga

SEQ ID NO: 2996 - RNA, 12 nt, Artificial
  siRNA construct
cggugaugucgg

SEQ ID NO: 2997 - RNA, 12 nt, Artificial
  siRNA construct
ucggugaugucg

SEQ ID NO: 2998 - RNA, 12 nt, Artificial
  siRNA construct
cucggugauguc

SEQ ID NO: 2999 - RNA, 12 nt, Artificial
  siRNA construct
gcucggugaugu

SEQ ID NO: 3000 - RNA, 12 nt, Artificial
  siRNA construct
agcucggugaug

SEQ ID NO: 3001 - RNA, 12 nt, Artificial
  siRNA construct
cagcucggugau

SEQ ID NO: 3002 - RNA, 12 nt, Artificial
  siRNA construct
ccagcucgguga

SEQ ID NO: 3003 - RNA, 12 nt, Artificial
  siRNA construct
gccagcucggug

SEQ ID NO: 3004 - RNA, 12 nt, Artificial
  siRNA construct
agccagcucggu

SEQ ID NO: 3005 - RNA, 12 nt, Artificial
  siRNA construct
gagccagcucgg

SEQ ID NO: 3006 - RNA, 12 nt, Artificial
  siRNA construct
ggagccagcucg

SEQ ID NO: 3007 - RNA, 12 nt, Artificial
  siRNA construct
aggagccagcuc

SEQ ID NO: 3008 - RNA, 12 nt, Artificial
  siRNA construct
caggagccagcu

SEQ ID NO: 3009 - RNA, 12 nt, Artificial
  siRNA construct
gcaggagccagc

SEQ ID NO: 3010 - RNA, 12 nt, Artificial
  siRNA construct
ggcaggagccag

SEQ ID NO: 3011 - RNA, 12 nt, Artificial
  siRNA construct
uggcaggagcca

SEQ ID NO: 3012 - RNA, 12 nt, Artificial
  siRNA construct
cuggcaggagcc

SEQ ID NO: 3013 - RNA, 12 nt, Artificial
  siRNA construct
gcuggcaggagc

SEQ ID NO: 3014 - RNA, 12 nt, Artificial
  siRNA construct
ggcuggcaggag

SEQ ID NO: 3015 - RNA, 12 nt, Artificial
  siRNA construct
cuaugcucccgc

SEQ ID NO: 3016 - RNA, 12 nt, Artificial
  siRNA construct
ucuaugcucccg

SEQ ID NO: 3017 - RNA, 12 nt, Artificial
  siRNA construct
gucuaugcuccc

SEQ ID NO: 3018 - RNA, 12 nt, Artificial
  siRNA construct
cgucuaugcucc

SEQ ID NO: 3019 - RNA, 12 nt, Artificial
  siRNA construct
ucgucuaugcuc

SEQ ID NO: 3020 - RNA, 12 nt, Artificial
  siRNA construct
cucgucuaugcu

SEQ ID NO: 3021 - RNA, 12 nt, Artificial
  siRNA construct
ucucgucuaugc

SEQ ID NO: 3022 - RNA, 12 nt, Artificial
  siRNA construct
cucucgucuaug

SEQ ID NO: 3023 - RNA, 12 nt, Artificial
  siRNA construct
ccucucgucuau

SEQ ID NO: 3024 - RNA, 12 nt, Artificial
  siRNA construct
gccucucgucua

SEQ ID NO: 3025 - RNA, 12 nt, Artificial
  siRNA construct
ggccucucgucu

SEQ ID NO: 3026 - RNA, 12 nt, Artificial
  siRNA construct
acacgcaccagg

SEQ ID NO: 3027 - RNA, 12 nt, Artificial
  siRNA construct
gacacgcaccag

SEQ ID NO: 3028 - RNA, 12 nt, Artificial
  siRNA construct
ugacacgcacca

SEQ ID NO: 3029 - RNA, 12 nt, Artificial
  siRNA construct
uugacacgcacc

SEQ ID NO: 3030 - RNA, 12 nt, Artificial
  siRNA construct
cuugacacgcac

SEQ ID NO: 3031 - RNA, 12 nt, Artificial
  siRNA construct
ccuugacacgca

SEQ ID NO: 3032 - RNA, 12 nt, Artificial
  siRNA construct
uccuugacacgc

SEQ ID NO: 3033 - RNA, 12 nt, Artificial
  siRNA construct
cuccuugacacg

SEQ ID NO: 3034 - RNA, 12 nt, Artificial
  siRNA construct
ccuccuugacac

SEQ ID NO: 3035 - RNA, 12 nt, Artificial
  siRNA construct
uccuccuugaca

SEQ ID NO: 3036 - RNA, 12 nt, Artificial
  siRNA construct
cuccuccuugac

SEQ ID NO: 3037 - RNA, 12 nt, Artificial
  siRNA construct
gcuccuccuuga

SEQ ID NO: 3038 - RNA, 12 nt, Artificial
  siRNA construct
ggcuccuccuug

SEQ ID NO: 3039 - RNA, 12 nt, Artificial
  siRNA construct
uagcauccaagu

SEQ ID NO: 3040 - RNA, 12 nt, Artificial
  siRNA construct
auagcauccaag

SEQ ID NO: 3041 - RNA, 12 nt, Artificial
  siRNA construct
cauagcauccaa

SEQ ID NO: 3042 - RNA, 12 nt, Artificial
  siRNA construct
ccauagcaucca

SEQ ID NO: 3043 - RNA, 12 nt, Artificial
  siRNA construct
uccauagcaucc

SEQ ID NO: 3044 - RNA, 12 nt, Artificial
  siRNA construct
guccauagcauc

SEQ ID NO: 3045 - RNA, 12 nt, Artificial
  siRNA construct
aguccauagcau

SEQ ID NO: 3046 - RNA, 12 nt, Artificial
  siRNA construct
gaguccauagca

SEQ ID NO: 3047 - RNA, 12 nt, Artificial
  siRNA construct
ggaguccauagc

SEQ ID NO: 3048 - RNA, 12 nt, Artificial
  siRNA construct
uggaguccauag

SEQ ID NO: 3049 - RNA, 12 nt, Artificial
  siRNA construct
uuggaguccaua

SEQ ID NO: 3050 - RNA, 12 nt, Artificial
  siRNA construct
guuggaguccau

SEQ ID NO: 3051 - RNA, 12 nt, Artificial
  siRNA construct
gguuggagucca

SEQ ID NO: 3052 - RNA, 12 nt, Artificial
  siRNA construct
agguuggagucc

SEQ ID NO: 3053 - RNA, 12 nt, Artificial
  siRNA construct
cagguuggaguc

SEQ ID NO: 3054 - RNA, 12 nt, Artificial
  siRNA construct
ccagguuggagu

SEQ ID NO: 3055 - RNA, 12 nt, Artificial
  siRNA construct
uggucugcaggu

SEQ ID NO: 3056 - RNA, 12 nt, Artificial
  siRNA construct
auggucugcagg

SEQ ID NO: 3057 - RNA, 12 nt, Artificial
  siRNA construct
cauggucugcag

SEQ ID NO: 3058 - RNA, 12 nt, Artificial
  siRNA construct
gcauggucugca

SEQ ID NO: 3059 - RNA, 12 nt, Artificial
  siRNA construct
agcauggucugc

SEQ ID NO: 3060 - RNA, 12 nt, Artificial
  siRNA construct
cagcauggucug

SEQ ID NO: 3061 - RNA, 12 nt, Artificial
  siRNA construct
ucagcauggucu

SEQ ID NO: 3062 - RNA, 12 nt, Artificial
  siRNA construct
cucagcaugguc

SEQ ID NO: 3063 - RNA, 12 nt, Artificial
  siRNA construct
gcucagcauggu

SEQ ID NO: 3064 - RNA, 12 nt, Artificial
  siRNA construct
ugcucagcaugg

SEQ ID NO: 3065 - RNA, 12 nt, Artificial
  siRNA construct
cugcucagcaug

SEQ ID NO: 3066 - RNA, 12 nt, Artificial
  siRNA construct
gcugcucagcau

SEQ ID NO: 3067 - RNA, 12 nt, Artificial
  siRNA construct
ggcugcucagca

SEQ ID NO: 3068 - RNA, 12 nt, Artificial
  siRNA construct
uggcugcucagc

SEQ ID NO: 3069 - RNA, 12 nt, Artificial
  siRNA construct
guggcugcucag

SEQ ID NO: 3070 - RNA, 12 nt, Artificial
  siRNA construct
cguggcugcuca

SEQ ID NO: 3071 - RNA, 12 nt, Artificial
  siRNA construct
ccguggcugcuc

SEQ ID NO: 3072 - RNA, 12 nt, Artificial
  siRNA construct
gccguggcugcu

SEQ ID NO: 3073 - RNA, 12 nt, Artificial
  siRNA construct
agccguggcugc

SEQ ID NO: 3074 - RNA, 12 nt, Artificial
  siRNA construct
aagccguggcug

SEQ ID NO: 3075 - RNA, 12 nt, Artificial
  siRNA construct
gaagccguggcu

SEQ ID NO: 3076 - RNA, 12 nt, Artificial
  siRNA construct
ugaagccguggc

SEQ ID NO: 3077 - RNA, 12 nt, Artificial
  siRNA construct
cugaagccgugg

SEQ ID NO: 3078 - RNA, 12 nt, Artificial
  siRNA construct
gcugaagccgug

SEQ ID NO: 3079 - RNA, 12 nt, Artificial
  siRNA construct
cgcugaagccgu

SEQ ID NO: 3080 - RNA, 12 nt, Artificial
  siRNA construct
acgcugaagccg

SEQ ID NO: 3081 - RNA, 12 nt, Artificial
  siRNA construct
cacgcugaagcc

SEQ ID NO: 3082 - RNA, 12 nt, Artificial
  siRNA construct
ccacgcugaagc

SEQ ID NO: 3083 - RNA, 12 nt, Artificial
  siRNA construct
uccacgcugaag

SEQ ID NO: 3084 - RNA, 12 nt, Artificial
  siRNA construct
guccacgcugaa

SEQ ID NO: 3085 - RNA, 12 nt, Artificial
  siRNA construct
uguccacgcuga

SEQ ID NO: 3086 - RNA, 12 nt, Artificial
  siRNA construct
guguccacgcug

SEQ ID NO: 3087 - RNA, 12 nt, Artificial
  siRNA construct
gguguccacgcu

SEQ ID NO: 3088 - RNA, 12 nt, Artificial
  siRNA construct
ugguguccacgc

SEQ ID NO: 3089 - RNA, 12 nt, Artificial
  siRNA construct
gguccagcaggg

SEQ ID NO: 3090 - RNA, 12 nt, Artificial
  siRNA construct
agguccagcagg

SEQ ID NO: 3091 - RNA, 12 nt, Artificial
  siRNA construct
cagguccagcag

SEQ ID NO: 3092 - RNA, 12 nt, Artificial
  siRNA construct
acagguccagca

SEQ ID NO: 3093 - RNA, 12 nt, Artificial
  siRNA construct
aacagguccagc

SEQ ID NO: 3094 - RNA, 12 nt, Artificial
  siRNA construct
gaacagguccag

SEQ ID NO: 3095 - RNA, 12 nt, Artificial
  siRNA construct
ugaacaggucca

SEQ ID NO: 3096 - RNA, 12 nt, Artificial
  siRNA construct
cugaacaggucc

SEQ ID NO: 3097 - RNA, 12 nt, Artificial
  siRNA construct
gcugaacagguc

SEQ ID NO: 3098 - RNA, 12 nt, Artificial
  siRNA construct
ggcugaacaggu

SEQ ID NO: 3099 - RNA, 12 nt, Artificial
  siRNA construct
cggucaccgagg

SEQ ID NO: 3100 - RNA, 12 nt, Artificial
  siRNA construct
acggucaccgag

SEQ ID NO: 3101 - RNA, 12 nt, Artificial
  siRNA construct
cacggucaccga

SEQ ID NO: 3102 - RNA, 12 nt, Artificial
  siRNA construct
gcacggucaccg

SEQ ID NO: 3103 - RNA, 12 nt, Artificial
  siRNA construct
ggcacggucacc

SEQ ID NO: 3104 - RNA, 12 nt, Artificial
  siRNA construct
gggcacggucac

SEQ ID NO: 3105 - RNA, 12 nt, Artificial
  siRNA construct
cgggcacgguca

SEQ ID NO: 3106 - RNA, 12 nt, Artificial
  siRNA construct
ucgggcacgguc

SEQ ID NO: 3107 - RNA, 12 nt, Artificial
  siRNA construct
gucgggcacggu

SEQ ID NO: 3108 - RNA, 12 nt, Artificial
  siRNA construct
ugucgggcacgg

SEQ ID NO: 3109 - RNA, 12 nt, Artificial
  siRNA construct
augucgggcacg

SEQ ID NO: 3110 - RNA, 12 nt, Artificial
  siRNA construct
caugucgggcac

SEQ ID NO: 3111 - RNA, 12 nt, Artificial
  siRNA construct
ucaugucgggca

SEQ ID NO: 3112 - RNA, 12 nt, Artificial
  siRNA construct
cucaugucgggc

SEQ ID NO: 3113 - RNA, 12 nt, Artificial
  siRNA construct
gcucaugucggg

SEQ ID NO: 3114 - RNA, 12 nt, Artificial
  siRNA construct
ggcucaugucgg

SEQ ID NO: 3115 - RNA, 12 nt, Artificial
  siRNA construct
aggcucaugucg

SEQ ID NO: 3116 - RNA, 12 nt, Artificial
  siRNA construct
caggcucauguc

SEQ ID NO: 3117 - RNA, 12 nt, Artificial
  siRNA construct
gcaggcucaugu

SEQ ID NO: 3118 - RNA, 12 nt, Artificial
  siRNA construct
ggcaggcucaug

SEQ ID NO: 3119 - RNA, 12 nt, Artificial
  siRNA construct
aggcaggcucau

SEQ ID NO: 3120 - RNA, 12 nt, Artificial
  siRNA construct
caggcaggcuca

SEQ ID NO: 3121 - RNA, 12 nt, Artificial
  siRNA construct
ucaggcaggcuc

SEQ ID NO: 3122 - RNA, 12 nt, Artificial
  siRNA construct
gucaggcaggcu

SEQ ID NO: 3123 - RNA, 12 nt, Artificial
  siRNA construct
ggucaggcaggc

SEQ ID NO: 3124 - RNA, 12 nt, Artificial
  siRNA construct
aggucaggcagg

SEQ ID NO: 3125 - RNA, 12 nt, Artificial
  siRNA construct
aaggucaggcag

SEQ ID NO: 3126 - RNA, 12 nt, Artificial
  siRNA construct
caaggucaggca

SEQ ID NO: 3127 - RNA, 12 nt, Artificial
  siRNA construct
ucaaggucaggc

SEQ ID NO: 3128 - RNA, 12 nt, Artificial
  siRNA construct
gucaaggucagg

SEQ ID NO: 3129 - RNA, 12 nt, Artificial
  siRNA construct
ugucaaggucag

SEQ ID NO: 3130 - RNA, 12 nt, Artificial
  siRNA construct
cugucaagguca

SEQ ID NO: 3131 - RNA, 12 nt, Artificial
  siRNA construct
gcugucaagguc

SEQ ID NO: 3132 - RNA, 12 nt, Artificial
  siRNA construct
ugcugucaaggu

SEQ ID NO: 3133 - RNA, 12 nt, Artificial
  siRNA construct
cugcugucaagg

SEQ ID NO: 3134 - RNA, 12 nt, Artificial
  siRNA construct
gcugcugucaag

SEQ ID NO: 3135 - RNA, 12 nt, Artificial
  siRNA construct
ggcugcugucaa

SEQ ID NO: 3136 - RNA, 12 nt, Artificial
  siRNA construct
aggcugcuguca

SEQ ID NO: 3137 - RNA, 12 nt, Artificial
  siRNA construct
caggcugcuguc

SEQ ID NO: 3138 - RNA, 12 nt, Artificial
  siRNA construct
ccaggcugcugu

SEQ ID NO: 3139 - RNA, 12 nt, Artificial
  siRNA construct
gcucuuggauac

SEQ ID NO: 3140 - RNA, 12 nt, Artificial
  siRNA construct
agcucuuggaua

SEQ ID NO: 3141 - RNA, 12 nt, Artificial
  siRNA construct
gagcucuuggau

SEQ ID NO: 3142 - RNA, 12 nt, Artificial
  siRNA construct
ggagcucuugga

SEQ ID NO: 3143 - RNA, 12 nt, Artificial
  siRNA construct
aggagcucuugg

SEQ ID NO: 3144 - RNA, 12 nt, Artificial
  siRNA construct
caggagcucuug

SEQ ID NO: 3145 - RNA, 12 nt, Artificial
  siRNA construct
acaggagcucuu

SEQ ID NO: 3146 - RNA, 12 nt, Artificial
  siRNA construct
gacaggagcucu

SEQ ID NO: 3147 - RNA, 12 nt, Artificial
  siRNA construct
agacaggagcuc

SEQ ID NO: 3148 - RNA, 12 nt, Artificial
  siRNA construct
gagacaggagcu

SEQ ID NO: 3149 - RNA, 12 nt, Artificial
  siRNA construct
ggagacaggagc

SEQ ID NO: 3150 - RNA, 12 nt, Artificial
  siRNA construct
cuucccugaauc

SEQ ID NO: 3151 - RNA, 12 nt, Artificial
  siRNA construct
gcuucccugaau

SEQ ID NO: 3152 - RNA, 12 nt, Artificial
  siRNA construct
ugcuucccugaa

SEQ ID NO: 3153 - RNA, 12 nt, Artificial
  siRNA construct
cugcuucccuga

SEQ ID NO: 3154 - RNA, 12 nt, Artificial
  siRNA construct
gcugcuucccug

SEQ ID NO: 3155 - RNA, 12 nt, Artificial
  siRNA construct
agcugcuucccu

SEQ ID NO: 3156 - RNA, 12 nt, Artificial
  siRNA construct
cagcugcuuccc

SEQ ID NO: 3157 - RNA, 12 nt, Artificial
  siRNA construct
ccagcugcuucc

SEQ ID NO: 3158 - RNA, 12 nt, Artificial
  siRNA construct
ccacggagccgg

SEQ ID NO: 3159 - RNA, 12 nt, Artificial
  siRNA construct
uccacggagccg

SEQ ID NO: 3160 - RNA, 12 nt, Artificial
  siRNA construct
guccacggagcc

SEQ ID NO: 3161 - RNA, 12 nt, Artificial
  siRNA construct
uguccacggagc

SEQ ID NO: 3162 - RNA, 12 nt, Artificial
  siRNA construct
guguccacggag

SEQ ID NO: 3163 - RNA, 12 nt, Artificial
  siRNA construct
gguguccacgga

SEQ ID NO: 3164 - RNA, 12 nt, Artificial
  siRNA construct
cgguguccacgg

SEQ ID NO: 3165 - RNA, 12 nt, Artificial
  siRNA construct
ccgguguccacg

SEQ ID NO: 3166 - RNA, 12 nt, Artificial
  siRNA construct
cccgguguccac

SEQ ID NO: 3167 - RNA, 12 nt, Artificial
  siRNA construct
ucccggugucca

SEQ ID NO: 3168 - RNA, 12 nt, Artificial
  siRNA construct
cucccggugucc

SEQ ID NO: 3169 - RNA, 12 nt, Artificial
  siRNA construct
gcucccgguguc

SEQ ID NO: 3170 - RNA, 12 nt, Artificial
  siRNA construct
aacagcaccggc

SEQ ID NO: 3171 - RNA, 12 nt, Artificial
  siRNA construct
aaacagcaccgg

SEQ ID NO: 3172 - RNA, 12 nt, Artificial
  siRNA construct
caaacagcaccg

SEQ ID NO: 3173 - RNA, 12 nt, Artificial
  siRNA construct
ucaaacagcacc

SEQ ID NO: 3174 - RNA, 12 nt, Artificial
  siRNA construct
cucaaacagcac

SEQ ID NO: 3175 - RNA, 12 nt, Artificial
  siRNA construct
gcucaaacagca

SEQ ID NO: 3176 - RNA, 12 nt, Artificial
  siRNA construct
agcucaaacagc

SEQ ID NO: 3177 - RNA, 12 nt, Artificial
  siRNA construct
cagcucaaacag

SEQ ID NO: 3178 - RNA, 12 nt, Artificial
  siRNA construct
ccagcucaaaca

SEQ ID NO: 3179 - RNA, 12 nt, Artificial
  siRNA construct
gggagauggugg

SEQ ID NO: 3180 - RNA, 12 nt, Artificial
  siRNA construct
agggagauggug

SEQ ID NO: 3181 - RNA, 12 nt, Artificial
  siRNA construct
cagggagauggu

SEQ ID NO: 3182 - RNA, 12 nt, Artificial
  siRNA construct
gcagggagaugg

SEQ ID NO: 3183 - RNA, 12 nt, Artificial
  siRNA construct
agcagggagaug

SEQ ID NO: 3184 - RNA, 12 nt, Artificial
  siRNA construct
cagcagggagau

SEQ ID NO: 3185 - RNA, 12 nt, Artificial
  siRNA construct
ucagcagggaga

SEQ ID NO: 3186 - RNA, 12 nt, Artificial
  siRNA construct
gucagcagggag

SEQ ID NO: 3187 - RNA, 12 nt, Artificial
  siRNA construct
augaacaaccug

SEQ ID NO: 3188 - RNA, 12 nt, Artificial
  siRNA construct
uaugaacaaccu

SEQ ID NO: 3189 - RNA, 12 nt, Artificial
  siRNA construct
cuaugaacaacc

SEQ ID NO: 3190 - RNA, 12 nt, Artificial
  siRNA construct
acuaugaacaac

SEQ ID NO: 3191 - RNA, 12 nt, Artificial
  siRNA construct
gacuaugaacaa

SEQ ID NO: 3192 - RNA, 12 nt, Artificial
  siRNA construct
ugacuaugaaca

SEQ ID NO: 3193 - RNA, 12 nt, Artificial
  siRNA construct
cugacuaugaac

SEQ ID NO: 3194 - RNA, 12 nt, Artificial
  siRNA construct
ucugacuaugaa

SEQ ID NO: 3195 - RNA, 19 nt, Artificial
  siRNA construct
uugagaacaucaagaggaa

SEQ ID NO: 3196 - RNA, 19 nt, Artificial
  siRNA construct
cccugaagagugaagacau

SEQ ID NO: 3197 - RNA, 19 nt, Artificial
  siRNA construct
ccugaagagugaagacaua

SEQ ID NO: 3198 - RNA, 19 nt, Artificial
  siRNA construct
cugaagagugaagacauaa

SEQ ID NO: 3199 - RNA, 19 nt, Artificial
  siRNA construct
ugaagagugaagacauaaa

SEQ ID NO: 3200 - RNA, 19 nt, Artificial
  siRNA construct
aagagugaagacauaaaga

SEQ ID NO: 3201 - RNA, 19 nt, Artificial
  siRNA construct
agagugaagacauaaagau

SEQ ID NO: 3202 - RNA, 19 nt, Artificial
  siRNA construct
gagugaagacauaaagauc

SEQ ID NO: 3203 - RNA, 19 nt, Artificial
  siRNA construct
gcagaagcaugcccagcaa

SEQ ID NO: 3204 - RNA, 19 nt, Artificial
  siRNA construct
agcucauucaguuccugau

SEQ ID NO: 3205 - RNA, 19 nt, Artificial
  siRNA construct
cucauucaguuccugaucu

SEQ ID NO: 3206 - RNA, 19 nt, Artificial
  siRNA construct
ucauucaguuccugaucuc

SEQ ID NO: 3207 - RNA, 19 nt, Artificial
  siRNA construct
cauucaguuccugaucuca

SEQ ID NO: 3208 - RNA, 19 nt, Artificial
  siRNA construct
ucucacuggugcagucaaa

SEQ ID NO: 3209 - RNA, 19 nt, Artificial
  siRNA construct
uggugcagucaaaccggau

SEQ ID NO: 3210 - RNA, 19 nt, Artificial
  siRNA construct
ggugcagucaaaccggauc

SEQ ID NO: 3211 - RNA, 19 nt, Artificial
  siRNA construct
gaacgacaguggcucagca

SEQ ID NO: 3212 - RNA, 19 nt, Artificial
  siRNA construct
gacaguggcucagcacauu

SEQ ID NO: 3213 - RNA, 19 nt, Artificial
  siRNA construct
guggcucagcacauuccau

SEQ ID NO: 3214 - RNA, 19 nt, Artificial
  siRNA construct
gcacauuccaugcccaagu

SEQ ID NO: 3215 - RNA, 19 nt, Artificial
  siRNA construct
gcgggagcauagacgagag

SEQ ID NO: 3216 - RNA, 19 nt, Artificial
  siRNA construct
acuuggaugcuauggacuc

SEQ ID NO: 3217 - RNA, 19 nt, Artificial
  siRNA construct
ugcugagcagccacggcuu

SEQ ID NO: 3218 - DNA, 21 bp, Artificial
  siRNA construct
cccugaagagugaagacautt

SEQ ID NO: 3219 - DNA, 21 bp, Artificial
  siRNA construct
augucuucacucuucagggtt

SEQ ID NO: 3220 - DNA, 21 bp, Artificial
  siRNA construct
ugaagagugaagacauaaatt

SEQ ID NO: 3221 - DNA, 21 bp, Artificial
  siRNA construct
uuuaugucuucacucuucatt

SEQ ID NO: 3222 - DNA, 21 bp, Artificial
  siRNA construct
aagagugaagacauaaagatt

SEQ ID NO: 3223 - DNA, 21 bp, Artificial
  siRNA construct
ucuuuaugucuucacucuutt

SEQ ID NO: 3224 - DNA, 21 bp, Artificial
  siRNA construct
agcucauucaguuccugautt

SEQ ID NO: 3225 - DNA, 21 bp, Artificial
  siRNA construct
aucaggaacugaaugagcutt

SEQ ID NO: 3226 - RNA, 21 nt, Artificial
  siRNA construct
cccugaagagugaagacauuu

SEQ ID NO: 3227 - RNA, 21 nt, Artificial
  siRNA construct
augucuucacucuucaggguu

SEQ ID NO: 3228 - RNA, 21 nt, Artificial
  siRNA construct
ugaagagugaagacauaaauu

SEQ ID NO: 3229 - RNA, 21 nt, Artificial
  siRNA construct
uuuaugucuucacucuucauu

SEQ ID NO: 3230 - RNA, 21 nt, Artificial
  siRNA construct
aagagugaagacauaaagauu

SEQ ID NO: 3231 - RNA, 21 nt, Artificial
  siRNA construct
ucuuuaugucuucacucuuuu

SEQ ID NO: 3232 - RNA, 21 nt, Artificial
  siRNA construct
agcucauucaguuccugauuu

SEQ ID NO: 3233 - RNA, 21 nt, Artificial
  siRNA construct
aucaggaacugaaugagcuuu

SEQ ID NO: 3234 - RNA, 21 nt, Artificial
  siRNA construct
cccugaagagugaagacauuu

SEQ ID NO: 3235 - RNA, 21 nt, Artificial
  siRNA construct
augucuucacucuucaggguu

SEQ ID NO: 3236 - RNA, 21 nt, Artificial
  siRNA construct
ugaagagugaagacauaaauu

SEQ ID NO: 3237 - RNA, 21 nt, Artificial
  siRNA construct
uuuaugucuucacucuucauu

SEQ ID NO: 3238 - RNA, 21 nt, Artificial
  siRNA construct
aagagugaagacauaaagauu

SEQ ID NO: 3239 - RNA, 21 nt, Artificial
  siRNA construct
ucuuuaugucuucacucuuuu

SEQ ID NO: 3240 - RNA, 21 nt, Artificial
  siRNA construct
agcucauucaguuccugauuu

SEQ ID NO: 3241 - RNA, 21 nt, Artificial
  siRNA construct
aucaggaacugaaugagcuuu

SEQ ID NO: 3242 - RNA, 21 nt, Artificial
  siRNA construct
cccugaagagugaagacauuu

SEQ ID NO: 3243 - RNA, 21 nt, Artificial
  siRNA construct
augucuucacucuucaggguu

SEQ ID NO: 3244 - RNA, 21 nt, Artificial
  siRNA construct
ugaagagugaagacauaaauu

SEQ ID NO: 3245 - RNA, 21 nt, Artificial
  siRNA construct
uuuaugucuucacucuucauu

SEQ ID NO: 3246 - RNA, 21 nt, Artificial
  siRNA construct
aagagugaagacauaaagauu

SEQ ID NO: 3247 - RNA, 21 nt, Artificial
  siRNA construct
ucuuuaugucuucacucuuuu

SEQ ID NO: 3248 - RNA, 21 nt, Artificial
  siRNA construct
agcucauucaguuccugauuu

SEQ ID NO: 3249 - RNA, 21 nt, Artificial
  siRNA construct
aucaggaacugaaugagcuuu

SEQ ID NO: 3250 - RNA, 21 nt, Artificial
  siRNA construct
cccugaagagugaagacauuu

SEQ ID NO: 3251 - RNA, 21 nt, Artificial
  siRNA construct
augucuucacucuucaggguu

SEQ ID NO: 3252 - RNA, 21 nt, Artificial
  siRNA construct
ugaagagugaagacauaaauu

SEQ ID NO: 3253 - RNA, 21 nt, Artificial
  siRNA construct
uuuaugucuucacucuucauu

SEQ ID NO: 3254 - RNA, 21 nt, Artificial
  siRNA construct
aagagugaagacauaaagauu

SEQ ID NO: 3255 - RNA, 21 nt, Artificial
  siRNA construct
ucuuuaugucuucacucuuuu

SEQ ID NO: 3256 - RNA, 21 nt, Artificial
  siRNA construct
agcucauucaguuccugauuu

SEQ ID NO: 3257 - RNA, 21 nt, Artificial
  siRNA construct
aucaggaacugaaugagcuuu

SEQ ID NO: 3258 - RNA, 21 nt, Artificial
  siRNA construct
cccugaagagugaagacauuu

SEQ ID NO: 3259 - RNA, 21 nt, Artificial
  siRNA construct
augucuucacucuucaggguu

SEQ ID NO: 3260 - RNA, 21 nt, Artificial
  siRNA construct
ugaagagugaagacauaaauu

SEQ ID NO: 3261 - RNA, 21 nt, Artificial
  siRNA construct
uuuaugucuucacucuucauu

SEQ ID NO: 3262 - RNA, 21 nt, Artificial
  siRNA construct
aagagugaagacauaaagauu

SEQ ID NO: 3263 - RNA, 21 nt, Artificial
  siRNA construct
ucuuuaugucuucacucuuuu

SEQ ID NO: 3264 - RNA, 21 nt, Artificial
  siRNA construct
agcucauucaguuccugauuu

SEQ ID NO: 3265 - RNA, 21 nt, Artificial
  siRNA construct
aucaggaacugaaugagcuuu

SEQ ID NO: 3266 - RNA, 21 nt, Artificial
  siRNA construct
cccugaagagugaagacauuu

SEQ ID NO: 3267 - RNA, 21 nt, Artificial
  siRNA construct
augucuucacucuucaggguu

SEQ ID NO: 3268 - RNA, 21 nt, Artificial
  siRNA construct
ugaagagugaagacauaaauu

SEQ ID NO: 3269 - RNA, 21 nt, Artificial
  siRNA construct
uuuaugucuucacucuucauu

SEQ ID NO: 3270 - RNA, 21 nt, Artificial
  siRNA construct
aagagugaagacauaaagauu

SEQ ID NO: 3271 - RNA, 21 nt, Artificial
  siRNA construct
ucuuuaugucuucacucuuuu

SEQ ID NO: 3272 - RNA, 21 nt, Artificial
  siRNA construct
agcucauucaguuccugauuu

SEQ ID NO: 3273 - RNA, 21 nt, Artificial
  siRNA construct
aucaggaacugaaugagcuuu

SEQ ID NO: 3274 - RNA, 21 nt, Artificial
  siRNA construct
cccugaagagugaagacauuu

SEQ ID NO: 3275 - RNA, 21 nt, Artificial
  siRNA construct
augucuucacucuucaggguu

SEQ ID NO: 3276 - RNA, 21 nt, Artificial
  siRNA construct
ugaagagugaagacauaaauu

SEQ ID NO: 3277 - RNA, 21 nt, Artificial
  siRNA construct
uuuaugucuucacucuucauu

SEQ ID NO: 3278 - RNA, 21 nt, Artificial
  siRNA construct
aagagugaagacauaaagauu

SEQ ID NO: 3279 - RNA, 21 nt, Artificial
  siRNA construct
ucuuuaugucuucacucuuuu

SEQ ID NO: 3280 - RNA, 21 nt, Artificial
  siRNA construct
agcucauucaguuccugauuu

SEQ ID NO: 3281 - RNA, 21 nt, Artificial
  siRNA construct
aucaggaacugaaugagcuuu

SEQ ID NO: 3282 - DNA, 21 bp, Artificial
  siRNA construct
gucagcagggagaugguggtt

SEQ ID NO: 3283 - DNA, 21 bp, Artificial
  siRNA construct
ugucagcagggagauggugtt

SEQ ID NO: 3284 - DNA, 21 bp, Artificial
  siRNA construct
ccuuggcuuugggaggcuctt

SEQ ID NO: 3285 - DNA, 21 bp, Artificial
  siRNA construct
uccuuggcuuugggaggcutt

SEQ ID NO: 3286 - DNA, 21 bp, Artificial
  siRNA construct
guccuuggcuuugggaggctt

SEQ ID NO: 3287 - DNA, 21 bp, Artificial
  siRNA construct
gguccuuggcuuugggaggtt

SEQ ID NO: 3288 - DNA, 21 bp, Artificial
  siRNA construct
ggguccuuggcuuugggagtt

We claim:

1. A composition comprising an RNAi agent to HSF1 comprising a first strand and a second strand, wherein the sequence of the first strand comprises the sequence of SEQ ID NO: 637, 638 or 639, and wherein the first and/or second strand are modified or unmodified, and wherein the first strand is about 30 or fewer nucleotides in length.

2. The composition of claim 1, wherein the composition further comprises a second RNAi agent to HSF1.

3. The composition of claim 1, wherein the first strand and the second strand form a duplex region about 15 to about 30 nucleotide pairs in length.

4. The composition of claim 1, wherein the first strand and the second strand are both about 19 to about 23 nucleotides in length.

5. The composition of claim 1, wherein the RNAi agent comprises a modification that causes the RNAi agent to have increased stability in a biological sample or environment.

6. The composition of claim 1, wherein the RNAi agent comprises a modified sugar backbone, including a phosphorothioate linkage, or a 2'-modified nucleotide.

7. The composition of claim 1, wherein the RNAi agent comprises: at least one 5'-uridine-adenine-3' (5'-ua-3') dinucleotide, wherein the uridine is a 2'-modified nucleotide; at least one 5'-uridine-guanine-3' (5'-ug-3') dinucleotide, wherein the 5'-uridine is a 2'-modified nucleotide; at least one 5'-cytidine-adenine-3' (5'-ca-3') dinucleotide, wherein the 5'-cytidine is a 2'-modified nucleotide; or at least one 5'-uridine-uridine-3' (5'-uu-3') dinucleotide, wherein the 5'-uridine is a 2'-modified nucleotide.

8. The composition of claim 1, wherein the RNAi agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2'-O—N-methylacetamido (2'-O—NMA).

9. The composition of claim 1, wherein the RNAi agent comprises a blunt end.

10. The composition of claim 1, wherein the RNAi agent comprises an overhang having 1 to 4 unpaired nucleotides.

11. The composition of claim 1, wherein the RNAi agent comprises an overhang at the 3'-end of the first strand of the RNAi agent.

12. The composition of claim 1, wherein the RNAi agent is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

13. The composition of claim 1, wherein the RNAi agent is capable of inhibiting expression of HSF1 by at least about 60% in WI-38 and/or HeLa cells in vitro.

14. The composition of claim 1, wherein the RNAi agent is capable of inhibiting expression of HSF1 by at least about 70% in WI-38 and/or HeLa cells in vitro.

15. The composition of claim 1, wherein the RNAi agent is capable of inhibiting expression of HSF1 by at least about 80% in WI-38 and/or HeLa cells in vitro.

16. The composition of claim 1, wherein the RNAi agent is capable of inhibiting expression of HSF1 by at least about 90% in WI-38 and/or HeLa cells in vitro.

17. The composition of claim 1, wherein the RNAi has an EC50 of no more than about 0.1 nM.

18. The composition of claim 1, wherein the RNAi has an EC50 of no more than about 0.01 nM.

19. The composition of claim 1, wherein the RNAi has an EC50 of no more than about 0.001 nM.

20. The composition according to claim 1, for use in a method of inhibiting the expression of HSF1 in an individual, the method comprising the step of administering to the individual a therapeutically effective amount of the composition.

21. The composition of claim 1, for use in the treatment of an cancer.

22. The composition of claim 1, wherein all pyrimidines are 2' O-methyl-modified nucleosides.

23. A composition comprising an RNAi agent to HSF1 comprising a first strand and a second strand, wherein the sequence of the first strand is the sequence of SEQ ID NO: 637, 638 or 639 and/or the sequence of the second strand is the sequence of SEQ ID NO: 125, 126 or 127, and wherein the first and/or second strand are modified or unmodified.

24. The composition of claim 23, wherein the composition further comprises a second RNAi agent to HSF1.

25. The composition of claim 23, wherein the RNAi agent comprises a modification that causes the RNAi agent to have increased stability in a biological sample or environment.

26. The composition of claim 23, wherein the RNAi agent comprises a modified sugar backbone, including a phosphorothioate linkage, or a 2'-modified nucleotide.

27. The composition of claim 23, wherein the RNAi agent comprises: at least one 5'-uridine-adenine-3' (5'-ua-3') dinucleotide, wherein the uridine is a 2'-modified nucleotide; at least one 5'-uridine-guanine-3' (5'-ug-3') dinucleotide, wherein the 5'-uridine is a 2'-modified nucleotide; at least one 5'-cytidine-adenine-3' (5'-ca-3') dinucleotide, wherein the 5'-cytidine is a 2'-modified nucleotide; or at least one 5'-uridine-uridine-3' (5'-uu-3') dinucleotide, wherein the 5'-uridine is a 2'-modified nucleotide.

28. The composition of claim 23, wherein the RNAi agent comprises a 2'-modification selected from the group consisting of: 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), and 2'-O—N-methylacetamido (2'-O—NMA).

29. The composition of claim 23, wherein the RNAi agent comprises a blunt end.

30. The composition of claim 23, wherein the RNAi agent comprises an overhang having 1 to 4 unpaired nucleotides.

31. The composition of claim 23, wherein the RNAi agent comprises an overhang at the 3'-end of the first strand of the RNAi agent.

32. The composition of claim 23, wherein the RNAi agent is ligated to one or more diagnostic compound, reporter group, cross-linking agent, nuclease-resistance conferring moiety, natural or unusual nucleobase, lipophilic molecule, cholesterol, lipid, lectin, steroid, uvaol, hecigenin, diosgenin, terpene, triterpene, sarsasapogenin, Friedelin, epifriedelanol-derivatized lithocholic acid, vitamin, carbohydrate, dextran, pullulan, chitin, chitosan, synthetic carbohydrate, oligo lactate 15-mer, natural polymer, low- or medium-molecular weight polymer, inulin, cyclodextrin, hyaluronic acid, protein, protein-binding agent, integrin-targeting molecule, polycationic, peptide, polyamine, peptide mimic, and/or transferrin.

33. The composition of claim 23, wherein the RNAi agent is capable of inhibiting expression of HSF1 by at least about 60% in WI-38 and/or HeLa cells in vitro.

34. The composition of claim 23, wherein the RNAi agent is capable of inhibiting expression of HSF1 by at least about 70% in WI-38 and/or HeLa cells in vitro.

35. The composition of claim 23, wherein the RNAi agent is capable of inhibiting expression of HSF1 by at least about 80% in WI-38 and/or HeLa cells in vitro.

36. The composition of claim 23, wherein the RNAi agent is capable of inhibiting expression of HSF1 by at least about 90% in WI-38 and/or HeLa cells in vitro.

37. The composition of claim 23, wherein the RNAi has an EC50 of no more than about 0.1 nM.

38. The composition of claim 23, wherein the RNAi has an EC50 of no more than about 0.01 nM.

39. The composition of claim 23, wherein the RNAi has an EC50 of no more than about 0.001 nM.

40. The composition of claim 23, wherein all pyrimidines are 2' O-methyl-modified nucleosides.

41. A method of treating cancer in an individual, comprising the step of administering to the individual a therapeutically effective amount of a composition comprising an RNAi agent to HSF1 comprising a first strand and a second strand, wherein the sequence of the first strand comprises the sequence of SEQ ID NO: 637, 638 or 639, and wherein the first and/or second strand are modified or unmodified, and wherein the first strand is about 30 or fewer nucleotides in length.

42. The method of claim 41, wherein the cancer is selected from the list of bladder, bone, breast, cervical, colon, colorectal, endometrial, fibrosarcoma, gastric, haematopoietic, intestine, kidney, liver, lung, lymphoma, neuroectodermal, neuroblastoma, Ewing's sarcoma, osteosarcoma, ovary, pancreas, pleura, prostate, skin, squamous cell, stomach, and testicular cancers, leukemia, promyelocytic leukemia, and Hodgkin's disease.

43. The method of claim 41, wherein the method further comprises the step of administering an additional treatment.

44. The method of claim 43, wherein administration of the composition comprising the RNAi agent and administration of the additional treatment are simultaneous, concurrent, separate or sequential.

45. The method of claim 41, wherein the composition comprises a second RNAi agent to HSF1.

46. A method of inhibiting the expression of HSF1 in an individual, comprising the step of administering to the individual a therapeutically effective amount of a composition comprising an RNAi agent to HSF1 comprising a first strand and a second strand, wherein the sequence of the first strand comprises the sequence of SEQ ID NO: 637, 638 or 639, and wherein the first and/or second strand are modified or unmodified, and wherein the first strand is about 30 or fewer nucleotides in length.

47. The method of claim 46, wherein the cancer is selected from the list of bladder, bone, breast, cervical, colon, colorectal, endometrial, fibrosarcoma, gastric, haematopoietic, intestine, kidney, liver, lung, lymphoma, neuroectodermal, neuroblastoma, Ewing's sarcoma, osteosarcoma, ovary, pancreas, pleura, prostate, skin, squamous cell, stomach, and testicular cancers, leukemia, promyelocytic leukemia, and Hodgkin's disease.

48. The method of claim 46, wherein the method further comprises the step of administering an additional cancer treatment.

49. The method of claim 46, wherein the method further comprises the step of administering an additional cancer treatment, wherein administration of the composition comprising the RNAi agent and administration of the additional cancer treatment are simultaneous, concurrent, separate or sequential.

50. The method of claim 46, wherein the composition further comprises a second RNAi agent to HSF1.

51. A method of inhibiting the expression of HSF1 in an cell, comprising the step of introducing into the cell a composition comprising an RNAi agent to HSF1 comprising a first strand and a second strand, wherein the sequence of the first strand is the sequence of SEQ ID NO: 637, 638 or 639, and wherein the first and/or second strand are modified or unmodified.

* * * * *